United States Patent 9,592,283 (IMMUNOLOGICAL COMPOSITIONS CONTAINING ATTENUATED HISTOPHILUS SOMNI) - sequence listing, part 4

SEQ ID NO: 4 - DNA, 2263460 bp, Histophilus somni (TK #42)
  misc_feature (43157)..(43161): n is a, c, g, or t
  misc_feature (77077)..(77166): n is a, c, g, or t
  misc_feature (77445)..(77500): n is a, c, g, or t
  misc_feature (77559)..(78360): n is a, c, g, or t
  misc_feature (78861)..(78972): n is a, c, g, or t
  misc_feature (79494)..(79531): n is a, c, g, or t
  misc_feature (79658)..(79767): n is a, c, g, or t
  misc_feature (79953)..(80300): n is a, c, g, or t
  misc_feature (80366)..(80366): n is a, c, g, or t
  misc_feature (80526)..(80556): n is a, c, g, or t
  misc_feature (80818)..(80870): n is a, c, g, or t
  misc_feature (81004)..(81104): n is a, c, g, or t
  misc_feature (81577)..(81875): n is a, c, g, or t
  misc_feature (82015)..(82474): n is a, c, g, or t
  misc_feature (82748)..(84114): n is a, c, g, or t
  misc_feature (84533)..(85879): n is a, c, g, or t
  misc_feature (86014)..(86212): n is a, c, g, or t
  misc_feature (86267)..(86368): n is a, c, g, or t
  misc_feature (86720)..(86720): n is a, c, g, or t
  misc_feature (86737)..(86737): n is a, c, g, or t
  misc_feature (86739)..(86739): n is a, c, g, or t
  misc_feature (86808)..(86808): n is a, c, g, or t
  misc_feature (87448)..(87854): n is a, c, g, or t
  misc_feature (87919)..(87919): n is a, c, g, or t
  misc_feature (87934)..(87934): n is a, c, g, or t
  misc_feature (87952)..(87952): n is a, c, g, or t
  misc_feature (88006)..(88006): n is a, c, g, or t
  misc_feature (88041)..(88041): n is a, c, g, or t
  misc_feature (88112)..(88269): n is a, c, g, or t
  misc_feature (88329)..(88587): n is a, c, g, or t
  misc_feature (91961)..(92672): n is a, c, g, or t
  misc_feature (96616)..(98185): n is a, c, g, or t
  misc_feature (243580)..(250973): n is a, c, g, or t
  misc_feature (256280)..(256280): n is a, c, g, or t
  misc_feature (259180)..(259798): n is a, c, g, or t
  misc_feature (288452)..(288566): n is a, c, g, or t
  misc_feature (288646)..(288711): n is a, c, g, or t
  misc_feature (288770)..(288995): n is a, c, g, or t
  misc_feature (289594)..(289668): n is a, c, g, or t
  misc_feature (291020)..(291116): n is a, c, g, or t
  misc_feature (291200)..(293227): n is a, c, g, or t
  misc_feature (293480)..(295361): n is a, c, g, or t
  misc_feature (296598)..(297001): n is a, c, g, or t
  misc_feature (306117)..(306117): n is a, c, g, or t
  misc_feature (334146)..(336310): n is a, c, g, or t
  misc_feature (362551)..(362570): n is a, c, g, or t
  misc_feature (362642)..(363504): n is a, c, g, or t
  misc_feature (363652)..(363728): n is a, c, g, or t
  misc_feature (371568)..(371626): n is a, c, g, or t
  misc_feature (380991)..(381001): n is a, c, g, or t
  misc_feature (381068)..(381218): n is a, c, g, or t
  misc_feature (381297)..(381424): n is a, c, g, or t
  misc_feature (381650)..(381685): n is a, c, g, or t
  misc_feature (382320)..(382566): n is a, c, g, or t
  misc_feature (422760)..(423049): n is a, c, g, or t
  misc_feature (423405)..(423427): n is a, c, g, or t
  misc_feature (423749)..(423927): n is a, c, g, or t
  misc_feature (424016)..(424032): n is a, c, g, or t
  misc_feature (424286)..(424299): n is a, c, g, or t
  misc_feature (424464)..(424575): n is a, c, g, or t
  misc_feature (424663)..(424695): n is a, c, g, or t
  misc_feature (424782)..(424860): n is a, c, g, or t
  misc_feature (425085)..(425140): n is a, c, g, or t
  misc_feature (425298)..(425704): n is a, c, g, or t
  misc_feature (426156)..(426624): n is a, c, g, or t
  misc_feature (426786)..(426786): n is a, c, g, or t
  misc_feature (426788)..(426788): n is a, c, g, or t
  misc_feature (426792)..(426792): n is a, c, g, or t
  misc_feature (426795)..(426795): n is a, c, g, or t
  misc_feature (426807)..(426807): n is a, c, g, or t
  misc_feature (426861)..(426954): n is a, c, g, or t
  misc_feature (427060)..(427157): n is a, c, g, or t
  misc_feature (428775)..(428992): n is a, c, g, or t
  misc_feature (429742)..(429754): n is a, c, g, or t
  misc_feature (429809)..(429850): n is a, c, g, or t
  misc_feature (467773)..(468635): n is a, c, g, or t
  misc_feature (513537)..(518267): n is a, c, g, or t
  misc_feature (552286)..(552362): n is a, c, g, or t
  misc_feature (552867)..(553381): n is a, c, g, or t
  misc_feature (607124)..(607125): n is a, c, g, or t
  misc_feature (607237)..(607763): n is a, c, g, or t
  misc_feature (630082)..(634516): n is a, c, g, or t
  misc_feature (664961)..(665370): n is a, c, g, or t
  misc_feature (665529)..(665886): n is a, c, g, or t
  misc_feature (672501)..(677163): n is a, c, g, or t
  misc_feature (708739)..(709204): n is a, c, g, or t
  misc_feature (806834)..(806932): n is a, c, g, or t
  misc_feature (808315)..(810604): n is a, c, g, or t
  misc_feature (811819)..(812460): n is a, c, g, or t
  misc_feature (812516)..(815282): n is a, c, g, or t
  misc_feature (815473)..(815559): n is a, c, g, or t
  misc_feature (926933)..(928313): n is a, c, g, or t
  misc_feature (932634)..(932634): n is a, c, g, or t
  misc_feature (970552)..(970555): n is a, c, g, or t
  misc_feature (971205)..(971303): n is a, c, g, or t
  misc_feature (971725)..(971803): n is a, c, g, or t
  misc_feature (971987)..(972172): n is a, c, g, or t
  misc_feature (972226)..(972484): n is a, c, g, or t
  misc_feature (974176)..(974326): n is a, c, g, or t
  misc_feature (975074)..(975998): n is a, c, g, or t
  misc_feature (977854)..(977854): n is a, c, g, or t
  misc_feature (978466)..(978466): n is a, c, g, or t
  misc_feature (981844)..(983093): n is a, c, g, or t
  misc_feature (985915)..(990152): n is a, c, g, or t
  misc_feature (990286)..(990314): n is a, c, g, or t
  misc_feature (1004286)..(1004474): n is a, c, g, or t
  misc_feature (1006706)..(1006706): n is a, c, g, or t
  misc_feature (1007440)..(1007809): n is a, c, g, or t
  misc_feature (1007933)..(1007998): n is a, c, g, or t
  misc_feature (1008820)..(1009411): n is a, c, g, or t
  misc_feature (1015481)..(1015481): n is a, c, g, or t
  misc_feature (1015533)..(1016185): n is a, c, g, or t
  misc_feature (1021912)..(1022170): n is a, c, g, or t
  misc_feature (1022207)..(1022417): n is a, c, g, or t
  misc_feature (1026288)..(1026288): n is a, c, g, or t
  misc_feature (1031120)..(1031128): n is a, c, g, or t
  misc_feature (1031170)..(1031319): n is a, c, g, or t
  misc_feature (1031388)..(1031394): n is a, c, g, or t
  misc_feature (1031558)..(1032209): n is a, c, g, or t
  misc_feature (1032507)..(1032598): n is a, c, g, or t
  misc_feature (1036715)..(1037236): n is a, c, g, or t
  misc_feature (1041456)..(1041668): n is a, c, g, or t
  misc_feature (1047106)..(1047495): n is a, c, g, or t
  misc_feature (1050091)..(1050160): n is a, c, g, or t
  misc_feature (1053449)..(1053516): n is a, c, g, or t
  misc_feature (1070508)..(1070508): n is a, c, g, or t
  misc_feature (1070523)..(1070523): n is a, c, g, or t
  misc_feature (1070865)..(1071023): n is a, c, g, or t
  misc_feature (1090759)..(1090799): n is a, c, g, or t
  misc_feature (1114021)..(1115080): n is a, c, g, or t
  misc_feature (1115142)..(1115142): n is a, c, g, or t
  misc_feature (1115144)..(1115144): n is a, c, g, or t
  misc_feature (1169680)..(1169807): n is a, c, g, or t
  misc_feature (1169867)..(1169867): n is a, c, g, or t
  misc_feature (1169873)..(1169873): n is a, c, g, or t
  misc_feature (1176067)..(1176154): n is a, c, g, or t
  misc_feature (1176985)..(1176985): n is a, c, g, or t
  misc_feature (1188712)..(1191855): n is a, c, g, or t
  misc_feature (1192185)..(1195495): n is a, c, g, or t
  misc_feature (1303227)..(1303372): n is a, c, g, or t
  misc_feature (1306783)..(1307128): n is a, c, g, or t
  misc_feature (1307711)..(1308000): n is a, c, g, or t
  misc_feature (1314011)..(1314260): n is a, c, g, or t
  misc_feature (1314352)..(1314398): n is a, c, g, or t
  misc_feature (1321226)..(1323351): n is a, c, g, or t
  misc_feature (1340125)..(1352087): n is a, c, g, or t
  misc_feature (1368237)..(1368502): n is a, c, g, or t
  misc_feature (1382977)..(1387059): n is a, c, g, or t
  misc_feature (1391285)..(1392308): n is a, c, g, or t
  misc_feature (1392667)..(1399681): n is a, c, g, or t
  misc_feature (1417423)..(1419039): n is a, c, g, or t
  misc_feature (1419317)..(1419341): n is a, c, g, or t
  misc_feature (1419696)..(1419786): n is a, c, g, or t
  misc_feature (1419928)..(1419945): n is a, c, g, or t
  misc_feature (1422415)..(1422608): n is a, c, g, or t
  misc_feature (1426596)..(1426687): n is a, c, g, or t
  misc_feature (1427286)..(1427319): n is a, c, g, or t
  misc_feature (1428007)..(1428223): n is a, c, g, or t
  misc_feature (1428501)..(1429111): n is a, c, g, or t
  misc_feature (1429305)..(1429357): n is a, c, g, or t
  misc_feature (1429476)..(1430995): n is a, c, g, or t
  misc_feature (1433458)..(1436314): n is a, c, g, or t
  misc_feature (1441632)..(1441911): n is a, c, g, or t
  misc_feature (1443259)..(1443729): n is a, c, g, or t
  misc_feature (1444061)..(1444070): n is a, c, g, or t
  misc_feature (1528865)..(1529148): n is a, c, g, or t
  misc_feature (1529497)..(1529864): n is a, c, g, or t
  misc_feature (1530787)..(1532742): n is a, c, g, or t
  misc_feature (1534298)..(1534773): n is a, c, g, or t
  misc_feature (1535194)..(1535205): n is a, c, g, or t
  misc_feature (1652019)..(1652087): n is a, c, g, or t
  misc_feature (1653183)..(1654260): n is a, c, g, or t
  misc_feature (1654397)..(1654719): n is a, c, g, or t
  misc_feature (1689804)..(1689923): n is a, c, g, or t
  misc_feature (1692583)..(1692700): n is a, c, g, or t
  misc_feature (1692913)..(1693210): n is a, c, g, or t
  misc_feature (1693298)..(1693381): n is a, c, g, or t
  misc_feature (1693519)..(1693594): n is a, c, g, or t
  misc_feature (1694050)..(1694129): n is a, c, g, or t
  misc_feature (1694407)..(1694413): n is a, c, g, or t
  misc_feature (1694497)..(1694566): n is a, c, g, or t
  misc_feature (1695229)..(1695247): n is a, c, g, or t
  misc_feature (1747838)..(1748572): n is a, c, g, or t
  misc_feature (1748656)..(1748949): n is a, c, g, or t
  misc_feature (1749030)..(1749384): n is a, c, g, or t
  misc_feature (1752075)..(1754121): n is a, c, g, or t
  misc_feature (1769847)..(1771151): n is a, c, g, or t
  misc_feature (1771269)..(1771485): n is a, c, g, or t
  misc_feature (1771532)..(1771936): n is a, c, g, or t
  misc_feature (1773956)..(1773980): n is a, c, g, or t
  misc_feature (1774087)..(1774175): n is a, c, g, or t
  misc_feature (1775011)..(1775097): n is a, c, g, or t
  misc_feature (1806562)..(1806578): n is a, c, g, or t
  misc_feature (1806723)..(1806723): n is a, c, g, or t
  misc_feature (1807159)..(1808779): n is a, c, g, or t
  misc_feature (1809284)..(1809399): n is a, c, g, or t
  misc_feature (1809494)..(1809571): n is a, c, g, or t
  misc_feature (1809646)..(1809773): n is a, c, g, or t
  misc_feature (1812820)..(1812976): n is a, c, g, or t
  misc_feature (1813846)..(1813928): n is a, c, g, or t
  misc_feature (1813991)..(1814026): n is a, c, g, or t
  misc_feature (1814437)..(1814503): n is a, c, g, or t
  misc_feature (1814857)..(1814938): n is a, c, g, or t
  misc_feature (1815150)..(1815283): n is a, c, g, or t
  misc_feature (1815477)..(1815925): n is a, c, g, or t
  misc_feature (1816071)..(1816189): n is a, c, g, or t
  misc_feature (1816240)..(1816297): n is a, c, g, or t
  misc_feature (1816480)..(1816586): n is a, c, g, or t
  misc_feature (1817524)..(1817691): n is a, c, g, or t
  misc_feature (1817919)..(1817919): n is a, c, g, or t
  misc_feature (1817923)..(1817924): n is a, c, g, or t
  misc_feature (1865855)..(1866896): n is a, c, g, or t
  misc_feature (1869358)..(1869790): n is a, c, g, or t
  misc_feature (1870894)..(1871342): n is a, c, g, or t
  misc_feature (1871668)..(1871959): n is a, c, g, or t
  misc_feature (1872655)..(1874469): n is a, c, g, or t
  misc_feature (1875511)..(1875621): n is a, c, g, or t
  misc_feature (1875916)..(1876071): n is a, c, g, or t
  misc_feature (1876303)..(1877886): n is a, c, g, or t
  misc_feature (1882950)..(1885665): n is a, c, g, or t
  misc_feature (1885862)..(1885960): n is a, c, g, or t
  misc_feature (1892371)..(1895192): n is a, c, g, or t
  misc_feature (1902581)..(1902691): n is a, c, g, or t
  misc_feature (1922597)..(1923451): n is a, c, g, or t
  misc_feature (1927919)..(1935559): n is a, c, g, or t
  misc_feature (1936039)..(1941154): n is a, c, g, or t
  misc_feature (1941220)..(1946046): n is a, c, g, or t
  misc_feature (1946444)..(1955895): n is a, c, g, or t
  misc_feature (1955958)..(1956174): n is a, c, g, or t
  misc_feature (1956511)..(1962051): n is a, c, g, or t
  misc_feature (1962186)..(1962322): n is a, c, g, or t
  misc_feature (1962511)..(1963559): n is a, c, g, or t
  misc_feature (1963613)..(1966015): n is a, c, g, or t
  misc_feature (1966061)..(1971022): n is a, c, g, or t
  misc_feature (1971087)..(1985460): n is a, c, g, or t
  misc_feature (1985785)..(1986573): n is a, c, g, or t
  misc_feature (1986863)..(1986908): n is a, c, g, or t
  misc_feature (1986959)..(1991559): n is a, c, g, or t
  misc_feature (1991713)..(1991833): n is a, c, g, or t
  misc_feature (1991961)..(1994518): n is a, c, g, or t
  misc_feature (2023531)..(2023542): n is a, c, g, or t
  misc_feature (2024461)..(2024488): n is a, c, g, or t
  misc_feature (2038713)..(2038729): n is a, c, g, or t
  misc_feature (2038900)..(2039011): n is a, c, g, or t
  misc_feature (2041460)..(2042203): n is a, c, g, or t
  misc_feature (2042587)..(2043343): n is a, c, g, or t
  misc_feature (2043778)..(2043809): n is a, c, g, or t
  misc_feature (2043859)..(2043973): n is a, c, g, or t
  misc_feature (2044168)..(2044201): n is a, c, g, or t
  misc_feature (2044389)..(2044949): n is a, c, g, or t
  misc_feature (2045181)..(2045187): n is a, c, g, or t
  misc_feature (2045275)..(2045344): n is a, c, g, or t
  misc_feature (2045863)..(2045863): n is a, c, g, or t
  misc_feature (2063776)..(2063865): n is a, c, g, or t
  misc_feature (2118877)..(2123420): n is a, c, g, or t
  misc_feature (2124903)..(2126281): n is a, c, g, or t
  misc_feature (2138555)..(2138700): n is a, c, g, or t
  misc_feature (2165780)..(2168447): n is a, c, g, or t
  misc_feature (2168494)..(2168495): n is a, c, g, or t
  misc_feature (2178030)..(2184376): n is a, c, g, or t
  misc_feature (2217530)..(2217630): n is a, c, g, or t
atcaaaaacaacgctcatcaaaaattaagaagcggaattctaatcttaaattcagcgttcgtcaaatcagaatagtcaaaatcgcagaataaagcttattttcccaatcaaaaagcacaagagcggctcggattatacgtttttttacaaaaatctcaagcaacctttttcagtttttttgttcttttaataaagatctttgagccagtttattgtagaattaccgtcaatttacaccgcacttttagataaaacttccaactatttaatttgcaaagatggataaaatgagttcaacagtttctacgctatggcgagattgcttattacaattacaagatcaagtatcttcaaatgactttacgacttggctacgaccattacaggacgatgtcagtgagagtaacatgatactttatgcaccaaattgtttcattaaaggatgggttgaaaatcattatctcactcaaatcacaaagcttgctcagcaattgttgaataatgatcaattcatggtaaagatacaagacggcataaaacctactgagaaaacaacaacgaatgttgagcaaaagacacaaaatgaaaactgtcataatgaaataacttcgcaacaaaattaccgctcttatctcaataaaaatcatgtctttgataactttgttgaaggtaaatccaaccaattggcacgagcagttgcccagaaagtggctaaaaatccgggtgagcaaagtgctaatccattgtttttgtatggtggtacaggtctaggcaaaacgcacctgttgcatgctgtaggaaacggcattttagcaaataatcctcatgctcaagttgtttatatgcatgcagaacgttttatgcaatcttatgtaaaagccttaaaatccgatagaatggacagttttaagcgattttatcgtactgttgatgccttactgattgatgatattcaattttttgccggtaaagatggtacgcaagaagaatttttccatatattcaactcgttatttgagcgtggtcgccaaattattttgacttctgatcgttatccgaaggaaattgagaaaattgaagatcgtttaaaatctcgtttcggttggggaattagtgttgctattgaacctcccgaattggaaaccagagtcgcgattttgttgaagaaagcggaagaaaaaaatatggttttacccgaagaggttgccatgtttattgggggaaaattacgtactaatgtgcgagaattagaaggtgcattaaaccgtgttcatgcacatgcggaatttaccggaaaagcgattaccattgattttgtacgtgaaactctaaaagacatgttggcattgcaagataaattggtaacaattgaaaatattcaaaaaattgtggcggattattatcggatcaaaatttcggatttaaaatcaaaaagacgctcacgtaatataacccgaccacgtcaattagctatggcattagctaaagaactaacgaatcgcagtcttcctgaaattggtaggaatttcggtgatcgggatcatacgaccgttctgcatgcttgtaaggccatagcaaaactccgagaagaagataatggtatccaagaagattggtcaaatttaatccgcacactgtcagtataagggagcagactatgcaatttattgtttcaagagaacatctattaaaaccattacaacaagtttgtggtgtattaagtagtcgtccaaattttcctatattaaacaatgtattattgcaaattgaggggaatgttttacgtattaccggtacagatctcgaagtagaactttcaacacaagcacaacttattcaagcatcgcaagacggtagttatacgattccggcaaaaaaattcttagatatttgccgcagttttcccgatgaagcggaaattactgtaatttttgaagaagagcgtgcattggtgagatccggtcgaagtaaatttaatttaaccgctttacctgcagacgaatatcctaatttagctgattggcaatcagaggtggatttttacctgcctcaaagtacattacgtcgcctaattgaagcaacacaattctctatggcaaaccaagatgctcgttatttcctaaacggtatgaagtttgaaactgaaggcaatttactacgaacagttgctactgatggacatcgactcgccgtttgcacaattccgttagagcaggatttgcatacacatgcagtcattttgcctcgcaaaggaatattagagttaatgagattactggaaaacagcgaacacgctgctcacgttcaaattggcacaaataatttacgcattgatttaggaagtattatttttacatcaaaattaattgatggtcgtttcccagactatcgtagagttctcccaagaaatgcaactcatattatggaaggtaattgggaactgctgaaacaagcttttgctcgtatggcaattctgtctagcgataaagttaaaactgtccgtttgcaattgacctcaaatcaattaaagattacagcaacaaatccggaacaagaagtggctgaggaaattttagatgtcatatataatggggcagatatggaagttggctttaatgtaagttatattttagatgtacttaatgccctaaaatgccaacaggtgcgattatgttttactgatgcctcatcaagttgtttattagaggatgctgatgatgaaagtgcagagtatgtcgttatgccgatgcgtctataaacaatggcaatatcacgcttaatcatcaatcatttccgcaacttaacagccatagatctggagtttgaacgtggctttaactttattattggcaacaatggaagcgggaaaacaagtttactggaagctattttttatttagggcatggacgctcatttaaaagtgcggttgcaaatagaataatttcttatcagcaaccgcactttattttacatggtaaaattcaagagcaacaacatcaatggtctgttggtttgcaaaaacaacgtcaaggtaacactttaatgaaaataaacggcgaggacgcaaaaaaaatttccgatcttgcccatttattgcccatgcaactcattacacctgaaggattaaccttattaaatggcggtcccagctatcgaagggcttatttagattgggggttatttcatcataacgcatcattttataatgcttggagtagcttaaatcgtttacttaaacaacgaaattctgccttacaacaagtttgttcttatgaaaaactcaaaatttgggatagagaattaaccaaacttgcttatcaagtgagctactggcgagaagcgtatgcggaagctttacgctcggaaatagaaaagacctgtcagctttttctacctgaactagaaatttctgttagctttcatcaaggctgggataaaaatatggactatgcggatctgttacaacaaaactttgagcgagatcgtgctttgggttataccttttccggacctcaaaaagcagattttcgttttaaagcaaacggattgccggttgaagatattttatctcgtggacaattaaaattgttaatgtgtgcattacgtttggctcaaggtgagcatttaatgcaacaaaaaaaacgccactgtatttttctacttgacgatttcgcttcagaattggaccaatataaacgcacattgcttgctgaacgcttacaaaaaaatggttcgcaagtttttgttactgcaataactcaagaacaattacaacagatacaaccagaaaagcaccgcactttttaccttgaaaacggaagaataaaagatctttaaaataagcaaaaaacaaacctgaccaattgtcaggcttcacatagcgttataaagatttatcttgtaccatacacaacaatagttttgccatgtgctgaaatcaaatgctgatcttctaacattttcaaaatacgcccaacagtttctcgtgagcaacctaccatttgtcctatttcctgacgagtaattttaatttgcataccgtccggatgagtcattgcatcaggcatcttagctaaatttaacaaggtttgagcgatacgacctgtcacatctaaaaatgccaaattgcttacctgctttgaagtattttgtaaacgatgagctaattgaccggctaaatacattaaaatttctggattaacttgaattaattggcgaaattttttataagaaatttctgcaatttcacatgagcttttagctttaacccaagccgaacgaggctgtgtttcatcaaataaaccagcttcgccaaaaaaatcaccttgacttaaataagtcaaaatcatttctttaccttcctcatcttttaccatcacggcaacagaccctctaattaaataataaagggtttccgccttttctccagcatgaatgagggagctttttgctgagtatttatgaatgtgacaatgagataggaaccactctaacgtcggatccatcgatggtgctgattgtccttgttgttctaacataaaatctcctagtcattttccatttaaaaaatccattttatttttaatattaatggattgatgtaactcagaccaaaccagtatcgctttcccctgacgaatgtttttaaataaattttctcttttttcggctaatgaaagctcggtactaccataatccgtaccttcacgtaaaataaagctatccacaatatttaataaggtttgctcttctaatttttcccatggaataagcattgcaaattgctccaatcttacctaaaaatttctattatgcaaataaactttccagcagtttccattgttgctcaaaaccttgattaggcaagtgcctaaagttatttcttacgtaacgcataaactgtccttcgcataaagtaacaagatgggaagcaataattttttcatcaagatgaaaagattttccttctctcaatttacgcatttgtagaatattcacaaactgtaattctaaacgatcaaaaaatcgtgcaactcgtgcttgtaactgactatcttcaaacattaaagcatgccctgttaaaattcgggttaatcccggattttttcgtgcaaaatcaagaatagtttgcaaaatatctctcacacgattcatggtattggtttcgttcttgatagagtgattaattcgactaaataaagtattttctatattatccaataatgcttcaaacattttggttttactgggaaaataacggtaaagtgcggcttcagaaacaccgacttcctgtgccaagcgagctgtcgtcatacgctccattcctcgttctgaatgtaacatatgggttagtacggttaatacctgttgacgacgttcttttactgttcgtttctcaattttttgcgttttttgttttgaggcaacaacgatttcagcatcgccaatatccaattgctgttgttccattattttttgcctgaatgaccaaaaccaccattaccacgatctgtttgctgaaattcttctacaatattgaactcagcttgtactacaggtacaaacactaattgtgcgatacgatcaccaatttcgattttgaaaggtttatcacttcgattccaaagagaaaccatgagtggaccttgataatctgaatcgattaaaccaactaaattgcctaatacaatcccatttttatgtcccaatcctgaacgaggcaaaatcactgctgctaaattaggatctgcaatataaatagataaacctgttgaaataagttttgtttctcctggctggacttcaaatccctcgtcaaccaacgctcgtaaatccaatcctgccgatcctatggttgcataagttggtaatggaaactcagttccaatacgtggatctaaaatttttacatcaatctttttcatttactttcttccaatttccatttataacgcacaataattttatcaaccaattgtttagctaagtcacttttatgtttcaatgtcaacctctcttgcccattttgccaaaacagctgcaatgcgttttgctctgaattaaatacttgcccaccggaaacatcatttgcacaaatcatatccaaatttttacgttgtaatttgtctttcgcatactgctccacattttgtgtttcagccgcaaatcctacaacaaaaggacgattttccattaaattggctacagttgcaagaatgtctggatttttgaccaactttaagaccatttcatcattaccggggattttcttaattttttgttctgcaatttgttctacacgataatcagctaccgctgcacaaccaataaaaatctgattttgttccgcactttgtattgcatgttgatacatttcttgtgccgaaactacattaatgcgttgtacattatgaggtgtcgctaaattgacaggtccactgattaaagtgacttttgcacctcgttgagcaaaagcttcagcaatagcaaaccccattttgcctgagctatgattactaatatagcgtaccggatcaatggcttctcttgttggacctgcggtaatcacaacacttacatcaagtaaatcttgagtatgtaaaaaggattggcaaagtgcggtaaaaatttcaaaaggttctgacattcttccgatacctacatcaccacaagcctgttcaccactattcggtccgataaactgcacaccacgagccatgagttgtgctaaattttgttgagtaacagtttgtgcatacatttgttggttcattgccggagccagaaaaattggagaattcgttgctagacaaatagtggataataaatcgtttgccataccgaccgccatgcgtgcaataaagtctgcactggcaggtgcaattacgataagatccgcccacttagccaattcaatatgtcccattgccaattcagcttcatgatcaagtaaagattgtgatacagcgttgccggaaattgcttgtaaagttaaaggtgttacaaattctgtcgctgcatttgttagcactactcgaacttctgcttgtgctttacgcaataaacgaattaattctatggttttatatgcagcaataccgccggtaattccaatgacaattcgttttccccgaataagattttgcattgttagtccttaatcacaatccaaagtgcggtcattttactgcaatttttcataagaaaacatttaattttgcgattttgcacgcaaaataaaaaatacagtatttaaaacagcaacaaatcccttcatctttatcgttaaatattttttcctttgctaacaagaattttctatgacacaacaaaatacaactttaatgccgagagaaaaactactgaaatatggagcttcatcacttgatgataaggaattattagcgattttcttacgtacaggtataaaaaattgtcctgttatgcaactctccgagttggtacttgctcatttttcttctttaagaggattaattaatgcagatcaaaagcatttttgccaaatgaaaggattgggtattactcaatttgtacaattacaagcctgtactgaaatgaccaaacgttatctcttacaagaattacagtttgcacaagaatttaccagccctgatacggttcgtatgtatttacagactgaattggaaaataaagatagagaaatttttatggtactgtttttggataatcaacatcgtttaataaaaaaagaggaaatgtttttaggtaccattaaccaggcaaatgtttatcctcgtgagattattaaaaccgcactattttgtaatgcagccgcacttattcttgcacataatcatccttccggtgtttcaacgccaagcatggcagacagaaaaatgaccgagaatataaaacaactatcagaattaatggaaatccgtgttttagatcattttatcattggtaaaggtaactatttctcctttgcagaacaaggctggatctaggataattcgatgaattattcaatctatttgcgtaaatttttatcatttttttcagtgaatttatctatttaggcttgagaatgataaacaaaggtcgtataattcacgacctttaatatagtgggtcggctatgcgacctgacgaggtagccttcaaaatcttgaattttgaagtggtccgaaccctaagctcgagcttatatttttattggagattaatatgtctagagtctgtcaagtaacaggcaagcgtccagcagttggtaacaaccgttcgcacgcaatgaatgcgactcgtcgtcgttttcttcctaacttacacactcaccgtttttgggttgagagtgaaaaacgtttcgtaactttacgcttaacagcgaaaggtatgcgtattattgataaaaaaggcattgatgcagtgttggctgaaatccgtgctcgtggcgagaaaatctaaggagctaaaaaatggcagctaaaggtgctcgtgaaaaaattcgcttagtttcaacagctgaaacaggtcatttttatacaacgactaaaaataaacgcaatatgccggaaaaaatggagatcaaaaaatttgatccggttgtgcgtaagcatgttatttacaaagaagctaaaatcaaataatttagttttcacgataaaaaagcccgacatgttcgggttttttattttttcaaattttactttttgccataagatagctgaaagacttactcttggaaaaaaaatatgcctgaattacctgaagttgaaacaaccttaaagggcgtaagcccttatttaaaagggtttataattgaaaaaatagtagtacgtaatcccaaattacgctgggaagtaagtaaagaactcagcacatttaaacacgttaaaattcttaacttaactcgtcgagccaagtatctcattatccacacggaacaaggttacattatcggacatttaggtatgtccggttcagtccgcattgtgccgcatgacaatcctgtcaataagcatgatcatttcgatattgttatgaacaacggcaagttactacgctataacgatgctcgtcgctttggtgcttggctatggacgaataaccttagtgaatttcatctttttttcaagttggggtcggaacctttatctgaaacgtttaattctacttatttgttcaaaaaatctcgtcaaaaaagcaccgcacttaaaactttcttgatggataattccgttgttgtaggggttggaaatatttatgcgaatgaaattttatttctatgtggacttcatccacaaaagatcgccaaaacattgacaaaaaaacaggctgaacaacttgttttcactattaaacaagtgcttaacgaagctattgaacaaggaggaacaaccctaaaagattttttacaacctgacggtcgccccggatattttgctcaaaaacttttggtttatggaaataaggacaagccttgtccaaggtgcggtacaaagataaaaagtattattattgggcaaagaaatagctttttttgtccgcaatgtcaaaaaaagtgacattactttctttgttttttaaaaaaaatatgttaaacatcaataatgtctttttattttcacaatcagtaaacgcaaaaaggaatatgtaatgaatggagcaaatttggtcgtagaatgtttaaaagctcacggcgtaacttccttatttggctatcccggtggggcgataatgccagtttatgatgcaatttatgattctggtttagatcatctactttgtcgtaatgagcaaggtgcagcaatggctgctattggatatgcaagatcaacaaataaagtcggtgtttgtgttgcgacgtcgggaccgggggcaacaaatttaattaccggtttaggtgatgccttgatggattcaattcccattattgcaattaccggacaagttgcctcaaattttattggtacagatgctttccaggaagctgatattcttgggttgtcacttgcctgtactaagcacagttttatcgttcaacatattgatgaattacctgaaatcattgctaaagctttccaaattgcacaaagtggtcgtcctggtcctgtgcttattgatcttccaaaagatgtgcaatttgcacctacatccttaaaacccattgtttatcccaaaattgcggattctttacaaaatttagtcgcacttgagcaagcgaaaaatttactttctcaagcaaaacgccctgtgctttatgtaggtggcggtgttggaatggcaaaaagctcggatggtatgagtggcgtaaaagctatacgcacttttcttgatataacaaatattccgtcagtatcaaccttaaaaggtttaggaacaatacctcccaaacatccactctatatgggaatgattggaatgcacggtacaaaagcggcaaattatgctgtgcaagaatgtgatttacttattgcttgtggggcaaggtttgatgatcgtgtaacgggaaaattagatacgtttgcaccacatgctaaagttattcatattgatattgatgttgctgaaattaacaaactccgtaaagcagatgttggactacaaggggatttggtggaggcggttactaaccttgcccaactattggatattgaaccgtggcgtaaagatattgagcagttaaaagcaagttttgattttaattatattgaaaatacagaagataaagagatagagccctgtgcattacttcacacattatccgaacgcaaagcaaaaaatgcggtgattacaactgatgtagggcaacatcaaatgtggtcggcacaacatatgaaacattatgaacctgaaaattatattacatctgcagggttcggttcgatgggcttcggtttgccggcagctatcggtgcggcaaaagctcgtccccaagatccagttattttaattactggtgatggctcattgatgatgaatattcaagaattgggttcgatcaagcgtggaaatttaccaatcaaaattttattgcttgataaccaacgtttgggtatggtgcgacagtggcaatcgctcttttttcatggtcgccatagccacactgttttagatgataatcctgattttgttactcttgcttctgcctttggtattgcaggtgaacgaattgaaaaggcaagtgaagtttccgatgctttggatcgattattaaatgccaaagaagcttatttactacatgtctgtatcccagatgaagaaaatgtatggccacttgtaccgccaaatacatgcaacagtaatatgattgaagaagatattggggtgtaaacaatgaaaacttacgatttaactattcaagcaaacaaacgccctgaaactttagagcgtttgttaagagttgtccgccatcgtggttttgaagtcattattctacatagtgaaagtaaaggtaatgttattgatttgagacttactgtgcaaagtgagcgagctattgaattattgattcatcaattagtgaaattaccggatgttattacattaagctaaagaacggtctaaatttgtataaattattatacaaaatagatggttagtttaaagggagataagttgtggaaggtgctgttttagcgattaaattgggattggttgaagagattgtttttgaaaatggttcaaagatgtcaacggcaattcggaagaaaccgatggaacaagctatcgttcatgaattaggtgcggaaggaaatgatgttggactgaaagcacatcatggaggcattgataaagcactgttttttatggctgaaagatcttttgctaaattaaccgctcttttgggtaagcatgatagctatcaaggagaagctatctatggtgaaaattttattgtttctttttttgatgaagaaaatgtatgtgtcggcgatcagtaccagatcggagatgtacaaattgaaatttcacaacctcgcataccttgtgaaatgttgtcaaaaaatgccaataataaaaatactcgagcgattgttgtagaaacagggctgaccggttggtatgtgagagtcattaaaaatggcgtgatcaaaaaaggggataaaatccggcgtttagctaacccttacccaaaattaaccattaaatatttaaattatttgctggcaacggaagcgactgtggagcttaaaactcaattagaacaagcaattgaatgtcctgttttggcggaggcttttaagcgttacttaaaaatgaaatggcgaaaaatcagttaaatatttggttaagtgagatattattaatcggcttatgtgaagaataaagaacgtgattaaatatttactgatataatggcgaaaatttttcagataattttaacaagcggtctctaattttgaatatttctttatttcgacaaattctctcctctacaaaatggcagaatgatatttttactttatccccgcaaaaacaagattggctattacatcaaggttcattaacccgaaaattacagcaatattgtcagcaactgaaagttgaaattgtggcggaaaaatgggtttctgacatgtcttttggatttaccggacatcatgagccaatttggttgcgtgaagtgatattaaaaggtgatgagcaagcttggatttttgcacaaactcgtttgccacaatctacgattgagaatgttgcacctgacattatcaatgtaggttcaacgcctattggcttatggcttttccctcaacaaccaaaaagaaaaacacttgaatggatatacgataccgcaacaggattatatgctcgtcgttcagtattgcttttaaatcaatatccaatcgaaattaaagaattgtttttgcaagattttaaattttttcaatcaaaggtctaaagcatgagaaccccgaaaaagacaaacaaaaaagcgaaaaaaatcaccgcacttacagaagatccgtattttttccaagagcaacagaaatatgctaatccaatcccgagtcgagagtttattttacaaattattcgtgattttaatgcacttatgtcgaaagaagatctgttcaagacattggctatcgttgatcctgaacaaaaagagggaatgcgtcgccgtttgcgtgcaatggaaaatgaagggcaattggtctttactaaaagaaagtgttacgccttgcctgaaaaattggatttattaaaggggtcagtgattggtcatcgtgaaggctatggttttttacaaatcgaaggaagcaagtcagattggtttattccaaatattcaaatgcaaaaagttatccatggtgattttgtattggcacaacctaatggctatgaccgtaaaggacgttcagaggtgcgtattgttcgagtgttagaaagtcgcaataaacatattgttgggcgttttttcatggaggaggggattggttatgtcgtgccggatgatagccgtattaatcgtgacattctgattccgaatgagtttcgcaacggagcgagaatgggacaggtagttgtggttgaacttaaacctcgtacagcaacatttacgcagttggttggaaaaattgtagaaattcttggggagaatatggcaaagggaatggaaactgaaattgctattcgcaatcatgatattcctcatatttttccaagtgcggtagaaaaacaagtaagaaaatatacggatagtgtgccggaggaagcaaaacaaggacgaagagatttaagaaccttaccattggtaaccattgatggtgaagatgcacgagattttgatgatgcggttttttgtcaaagaagtggtgatggcgggtggacattatgggttgccattgccgacgtgagctattacgtacgtttgcgtactgcattagataacgaagcatatcagcgtggcaattcggtttactttcctaaccgagttgtaccaatgttgccggagattttatcgaatggattatgttcgcttaatccacaggttgatcgtttgtgtatggtatgtgagatacgaatttcgccacagggaaaaatgactgattacagtttttatgaagcggtcatgaactcatatgcaagattaacttacactaaagttgcacaaattttggcaggtgatgaattattacaacaacgctatcatgttttagtaccgcacttacaagaattgcaccaaatgtatcaggctctgctgcaagctcgttatcagcgtggagccattgattttgaaactattgaaactaagtttatcttcaatgaaatgggacgtattgaatgtattgaacctatggtgcgtaacgatgcccataaaatcattgaagaatgtatgattttagcaaatattgcagcagctaattttatggaacgtcatcaagaacccgctttattccgtattcatgccggaccaagtcaagaaaaactcagtgcatttcgtgcttttctacgtgaatgtggcttaacgttaaaaggtggtataaaccccacaaccgcagattacgcacagttgttagcccaagttcgtgaacgtccggatcatgaattaattcaaactatgctacttcgttcacttagccaagctgtttatcaccctgataatattggacattttggtttagcactaacggaatatgcacattttacttcgcctattcgccgttatcctgatttaacgttacatcgtagtatcaaatatttattagcaaaacagcaaggttctaaaagaaaaacaaccgataccggcggttatcattattccctagaagaaatggatcttctcggtgatcattgttctttaaccgaacgccgagctgatgatgcaacaagagaagtggcagattggctaaaatgcgaatatatgcaagatcatgttggagatgaatttgacggtattatttcttccgtaaccggttttgggttgtttgtgcgtttagatgatttatttattgatgggctagttcatatttcaaccttagataatgattattatcaatttgactcaataaaacaacgtttaattggggaaaattccggtacgacttatcgtctcggtgataaagttaaaatccgtgttgaggcagtcagtttagctcaacgccaagtggattttgttttattatcgagtcagcgtaaacctagacgttccggcaaaacggcgaataagcgagcgaaacaaaaaagcttccaagaaaagaaccgcacttctaagatcgagcgacataaaagtgcggtaaaaataacaaaaaaattatcaaaaaaacaacaaagtccggcaagtaaaacaagaaaacagaaaaaacagaaaggataaaaaatcatggcagaaaatatttatggaattcatgcggtgcaggcttttcttattaatgcaccagaacgtttgatcgaagtttatgtgctaaaagggcgggaagataagcggttacaatccgtactgaatgagctttataaattaggtataagcgtacaatttttgaatcgtgatacattggataaaaaagcgaacggagaagtacatcaaggtatcattgctcgtgttcaaccagctaaagagttgaatgaaaatgacttggttgagatcttacaaaaaaaagcaaatccattattgctggtattggatggtatcacagatccgcataatttaggtgcttgtttacgatcagcagatgctgccggtgtttgtgctgtgattgtgccaaaagataaatcggcacaattgactgcgattgctcgtaaagtcgcttgtggagcggcggaagttgttcctcttgttcgtgtaacaaatttagcccgcactttacgagatctacagcaacaacataatatttgggttgtaggtacggctggcgaggcgattgaaactttatacgaagcgaaattaaccggcggtttagcacttgttatgggggctgagggagatggaatgcgtcgtttaacccgtgaaacttgcgatcaattgattagcattcctatggcgggttccgtatcttcattaaatgtttctgttgccacaggcatttgtctatttgaaattgtgcgacaaagattaggataatactttcttaatctaaaaaggttggatgtgatgtgaaatatatttattatgtaaattaaaaggactgaaccctgcagaatacagagtgcagtccttgaattaaatcagtccaatcagatcatattgtcaggaaatttttgctattttatacccttcttgtctagttttgcatacgtttgacagccaatgtttaagccattatcgcacgctaatctataatattgtttagctttagaaacatttctttgtacactctgtccgttttcatacatcacgccgagattgtgttgtgcatttgcatctccctgttcagccagttgtttgaataagggaaatgcgtcagaataattttgttgtttaataaattgtaaagcacgattaaatctttcggtatctgtttcggcaagtgtagattggacaataccgaaagagagtagggcggtaaggagggatttttttagattcatcagagctcctttgttgactgcttctcatggttcgtttaaaaaattagatatttaagttaattgcatcatcaataaagtattggtccatatcaaatgcaggtttcgcccctttatttttgcctactatttgagaaggcacaccagcgacagtagtgtattctgaaacggattgtaacactacggagtttgcaccaattttagcgtaacgcccaatttcgatatttcctaacactttagctccggacccaatcatcacaccttctcgaattttaggatgacgatcgccgctttctttgcccgttccccctaaagttacaccttgcaaaatagatacatcattttcaatgacagatgtttctcctatcacaatacctgtggcatgatcgaacataatgccgcaaccgattcttgctgcgggatggatatctacatcaaaggcaacggatatttggttttgtaaatagatcgccaatgcttttcgtccttgttgccataaataatgggtaatacgataactttgcaatgcgtggaagcctttcaaataaagtaacggtgtagagtattgttctacggcaggatctcgatgacgcacggctcggatatcgcaagccgcactttcgataatttgcggttgattttgatgtgcttcttcaataatttctcgcaatgcaatagcgggcataattggattagctaatttgttcgcaagaatatagcttaatgcactgcctagattgttatgttttaagatagttgcatgaaagaaactggctagcattggttcattttcagcgagttttgctgcttcagcacgaataagactccatacttctattgacatgttactcccttttgcgttttcttcccaataaagtaatagccgcatcttcaggttttttaccacaaaatagtatttgatatacctgctcggtaatcggcatttctacaccctgttgctgggctaataaaaaggtttcttttgtattgtaaaaaccctctataaccggaccaagttcattgatagccgttgtacaatcaaaaccttgtcctaacattaatccaaaacgacggttacgagactggttatcggtacaagtaaggactaaatcccctaagccggatgttcccataaacgtattcggattcgcacctagagatatgcccaaacgactgatttcagcgattcctcgagtaattaatgctgcacgtgcattagcaccaaaccccataccatcagaaatccctgcagcaatagcaattacatttttaaccgcccctccaagttgtacaccaatcatatcttgattaacatagactcggaatttgctacaatgaattctttcttggaactctaaggcaaattgttcgttatttgaggctaatgtaatagctgccggcatgccggcagccaattctttagcaaaggtaggtcctgataagactgctaaaggataaccatatcctacatgctcttcaacaacttcttgtaataagcgtcctgtatttcgctccagtcctttcgttgcccaagcgatacgttgatccgatcttaagtgcggtttaatttgcatgataacgtcgccaaaaacatgacttggtacaacaattaataactctctggagtattgaatggcttgtgctaaattgtcttctacatataaagaatcaggaaagtgaatattaggtaaaaatgcttgattttttcgctcattacgtaagcgttgacaatgttgaggatgatgtccccataagtaggttggatagccattgcgagaaaaggcaatagctaaggctgttccataagcaccggcaccaattacggtgattggagttggagaaggactgttatcattcatattttttcttagaattttcggaattaatagaaatcttagggtgttattacaacaccctgagagattaatggacttctttcttttctttttcttcagcttttgactcctcttgtgtttgttgacgttgcatatactcaacaaataaggcatcaaaattgaccggtgctagatttaaagccgggaaagtgccacgattcactaaactggaaattaattctcgtgcataagggaataacatatttgggcattgagatgttaggcaatgtgctaattgtacatcttctaaaccgcttatagcaaagatgcctgcctgttttacttcacagataaaagcaacatcttcactgccttccattgtagtttcaacagagatattcaggcaaacttcataaagatcttctgctaaatgggttgtttctgtgcttaaattaaaatccagtttcggtttccattcttgttggaaaatgtgcggtagattaggtgcttcaaaagaaacatctttaacgtaaatacgttgaatttgtaaaacaacttctgttccttgttcttctgttactgcatcttgatttttttctgtcatttttcgatccttatttatgttttttgactaaaggtaaatttgccgcaatccagccactgataccatctttcagtgagtaaactcgactaaatccttgtttaactaataattctgctgatgcacctgcattcatacctgttgcacaaactaaaattacaggggtatctttatgttgttcaatttttcctaaattttgatttttaatctctgttggcaatacattgatactgttgataatatgaccacgttgaaattcatctattgtgcgtaaatcaataacaatagcctcttcattattaattaaacgagtcgcttcggcgttttctactgccgtaactttactggtaaatgattttaccgatgtataaattaacatgacaaatacggcaatccatgctattaccattaagctatgattttttgcaaactctgttgctaaagggagatattcttgcattttttctatttttcaaggttaaagttaaggttaaaaataaagggttaagtataaccgcactttcttcatctttcaaaatttttcaaaaaaagtcctgcaaataaattgatctatattatagatagcttccctgtttattggtatattagccccaaatttcaaggaagtcttgataactttgttgaaatagggtttccgattttatcggaaacgatttttaagtagaaaaaataggaaaaaaaatgttttatattcaattcgctatcgttttagtgtgtattctgattggtgcacgcattggtggtatcggtttgggcgttatgggtggtttagggctttgtattctcgccttcggcttcgggttacaacctgctggattaccgattgatgtgatgtttatgattatggctgtagtttctgccgctgctgcaatgcaggcagctggtggtttggattatatgatcaaaatcgcaaccaatattttacgcagaaatcctaaatatatcacttttgtcgcacctgccgtaacttggttatttactttcttagccggtactggccatgtagcttattctgtattaccggttatcgcagaagtaagtcgtcacagcggtattcgtcctgagcgtccactttcaatggcagtaattgcatcgcaatttgctattgtagcaagtcctatcgctgccgctgtagtggctgttgtgaactatttagaaccacaaggaatcaacttgggtagcgtcttaatggttactattccgtcaactattttaggcatagcacttgcttgtgtttttgtcaataaaatggggaaagaattaaaagacgatccgaattatcaacgtttattacaaaatcctgagtatgtcaaagaaaacagcgtaagtaatattgctgaaattgaaataaaaccgactgcgaaattatcagtgggcttattcttattcggtgcattacttgttgttgtgatgggagcgtatccggagttacgtccatcattcaacgataaacctatgggtatggctcacactattgagatcgttatgttaaccgttggtgcattgattatcttaacctgtaaaccgaatggtaacgcaattacacaaggttccgtattccatgctggtatgcgtgcggtgattgcaatttttggtattgcttggttgggagatacattgatgcaaggtcatattgcaggcattaaagaaagtgtgaagttattagttgaaaccgcaccttgggcatttgcatttgcactgttcttactttctgttttggtaaacagtcaaggggcgactgtagcaactttatttccgctaggtattgcattaggtattgaacctgcgattttaatcggggtatttgtagcagtaaacggttatttctttattccaaactatggtccaattattgcttcaattgactttgatacaacaggcacaacaagaattggtaagtttatctttaatcacagctttatgcttccaggtttattaagtatggcatttagcttaggtttcgggttattgtttgcaagtattttactttagttttcactaaataatttataaaaacaccgcacttgctttaagaagtgcggtgttttttgagattttgattttttaaataccgaataaaacagcaatgaaaacggtcaagccgaaataattgttatttaaaaaagcgttaaagcaactcgctctatctctatttttagtcaaacggcattggtaaacgaaaaataagccggcaatagccaatacaataaaatatctgttatttaattgtgataaataacccacggaaaagagaaaaatcagcgttattatttgtaataatgcgatgattttattgtcatattgagcaaataaaatcgccgttgatttcacgccaatacgcaaatcatcatcacgatctaccatggcatattgagtatcatatgcgactgtccaagataaatttgcaataaataataaccagcattctagaggcaatgcttcaatagtcgcaccataagccattggaatagaccagccaaaagccgcccctaagaaaaattgtggcaaatgtgtataacgtttcataaagggataaataaatgccaaaatgactgcaatcacagataaaccaatagtataaaggtttaaacaaaggactaataaaaaagaacaaaaaacgaggacgataaataaccattttgcttcacgaggtgttgctcgacctgttgaaagtgggcgtagtgaagttcgtttaacttttccgtcaatatggcgatctgcataatcattgatgacacaacctgctgaacgcattaaaaatacgccgcatataaaaattgctaaaactgatagggtaggcatcgctttttcggcaagatataatgcccaaagcgttggccaaagtaaaagcaatgtgccgataggtttgtctaaacgcattaattgtccataagcaatcaacttatcttttgcaaatattgtcatttgattggctaaaccttgtaattcttaataaaagtgcggtgtattttactgtaaaatcctttttggaaaaagtgagtttaccctataaagaaacagtgttatattgcgaaatacttttattgttaaactatcataaaatgactacattcaaagaaatcaactctgaacaagcatgggaaatattaaataataagaatgctgtattagtagacattcgtgatttatcccattttatttacagtcgtccgcaaagtgcttttcatttaactcatcagcgttttagtgaattccaacagaaatatgaatacgaccaaccgattattgtgagttgttatcatggtgtgagtagccgcaatgtggcacaatttttagttgagcaaggctatgatgaagtttatagcttaattggaggtttcgccggttgggtacaagcgaatttaccggtggaaagtggatattaaataaaaggcagatcatttctgccttagttcagtccaaccgcacaaacatagatcaaaacactataaaaaatcgccgcacttagtagcaaaacatattttgccagcttactgttacgttgatttaatttaaatgaataacgagcaataatgcctaaaataaaaggataagcccaaaagaaaattgacatccatctcatttgaaaatcatccaaatttggatttttaatgaaattaggtgagattaagatagctaatggccaaagcaaaacaggtaggcaaaacccaacgagtgcccaagaaaatctactaaatccggttggcatgttttgttttttcatttttatcctcgataatatatacaagagaacaggaatatagcaaatgaaactattatttggtagtgaaagagagaattttattatttggtttcgtgattatatccgagctaagtatttgcttgaattgaccattcaaaactatattgatgaaaaatataatcggtcggtgcgtggtgtttttatcgaagaaaatcatccattattgacacagcttgaacaagagaaaatactttttctgcaggatccttttaacccttgttatcagcaggcagcttgggaagccggcgatacacattccattcagtacaaaaaaacatcatgggtggctatttggaaaatctcatcgaaatggttccaacaaggtaaaataactttatttattaccgcactttgcactctaatttacgttttacagaacttgggatttgagcaaggtattttctattttgctcattatccagcaaatccggcacaacaaacagaaatttggcgttatatttcgcatagtttagtgcatctctcgccactacattttttatttaatctaagttggttttggttatttggcggggcaattgaacgacagctgaatgcaaaaaaattactgttgctcttttttgtttcatctattttgaccggagtcgtgcaaaattatttctctgattatcgtttcttcgggttatctggtgtagtttatgcggtattgggttatgtatttattttagataaatttcattatgctaaatttgctttaccatcaggttttttcttgatgttaattatggggatcgccttaggttttattagtccgcttgtaggtatttatatgggcaacagtgctcatattagtggtttattatgtgggattttattaggcttatggcaagttaaaaaaagggagttttgagaactaaacgtaacatattgaaatcaatgaaatgtgtattgtcttatttctatgctctttcaaactcaagataaaatagatcgaaatttggaggatagagataaacgctgtcttgaagagaaatttattttgccattatggttattcttaattttcgcataaaatttgataatttcctttgactaattgacaatcaaaaggtaatattcacgccctatgcaaaaggtaaaactacccctaactgttgacccgattaaagatgcacagcgtagattggattatcaaggttgttatgtgtccaatcaagttactcgtttagcggagtcagtagtcaaagtgctcagcgatgtgcaggtaacattatcgtttttcgttgatccgcaaaaattgactgtaatgaaaggaagagcgagtgttgatgtggaattagaatgtcaacgttgtggttgtcctttcagtcaatcattggaatgtgagttttcttatagtccagtgtctgatttgggtaagatcaatgaattgccagagatttatgaaccgatagaattaaatgaattcggggaaatagatttaattggaacggttgaagatgaactgattgttgctcttccaattgttccgatgcattcatctgaacactgtgaagtgtccgtggctgaacaggtttttggcgaattgccggaagagctggcaaaaaaaccgaacccgttcgctgtattagctagtttaaagaaaaagtaaatttaggagtatagccaatggctgttcaacaaaataaaaaatctcgttcacgtcgtgatatgcgtcgttcacatgatgcgttaaccacagccgctgtatcggttgacaaaacaagcggagaaactcatttacgccaccatgtaaccgcagatggttattatcgtggtcgtaaagtgatcaataaataatcgttgattgtttaaggtaatcacttgagtcatctaactgttgtgttagatatgatgggcggggacatgagtccccgtattactatctgcgaattggtaaaagcgttgggtaagcatccaatgctgtctttgttgtttgctaataaccaacaaaattttcctctacgtcaacgttttccaatcgatagtcaaaattatttagccgtctgtcattgctctcatgtgattgaaaataatcagggtttagttcataccttagttcacatttttgtagaataccagctaggtttattttatctatatgcagctttgttaaatataggtattgaggaaaccaaagaatataaagaatataaagctattcgagatatggcattacaatcttcaaagaaaggttaaagaaaatcttgccggtttgaataaaattaagacgtaacttgatgagataattatgtacagtagaattttagcaaccggtagttatataccggctaatatcaggactaatgctgatttagaaaaaatggtagagacatctgatgaatggattactactcgttccggtataaaagagcgtcgtatcgccggtgaaaatgaaacagttgccacaatgggatttgaggccgctaaaaatgcacttcagttagccaatatttgccctaacgatatcgatttggttttggttgcgactaccagccactcctatgcttatccaagtgctgcatgccaaattcaaggtatgttggacattgatgatgcaatttctttcgatttggcggcagcttgcacggggtttatctatgctttaagtgttgcagatcaattcattaaaacaggtaaagtaaaaaaagctttagtgattggtgcagatattaattctcgtaagttagatgaaacggatcgtagcactattattttatttggtgacggtgctggtgccgtgatcttggaaagcagcgatattgaagggattatttctactcatttacatgcttctttagataaaagtaacgccttaattcttcctcaaactcaacatggtgaagcacaatccggttatattcaaatgcaagggaatgcaacttttaaacttgcagtacgagaattatctaatgtagtagaagaaactttacgtgataatcacttagacaaagctgatttagattggttggtacctcatcaagcaaacttacgtattatcacggcaactgctgaaaaattgaatatgtctttagatcaagtggtaattactttagacaagtacggtaatacaagtgcggcgacagtacctgtggcattggatgaagctgtacgtgacgggcgtattaagcgtggtcaattattattattagaagcatttggtggcggttggacttggggttctgcgttggttcgtttctaaattttaacaaaaattgaatatacttatttagtaggaaataaaaatgaaaaaatttgcaatggttttccctggacaaggctcacaagcagtgggaatgctggctgaattggctgcagaatatccgattgttgaagaaacttttcagcaagcttcctccgttttgggttatgatttatggcagttagtgcaacaaggtcctgcagaagaattgaataaaacgtggcaaacacaacccgcacttttagctgcttccgtggcaatttatcgtgtatggcaacaaaaatatcctcacctaaaacctgaagtgatggcaggacatagtttaggtgaatattccgctttagtatgtgccggtgtaattgatttccaagatggaattaaattggtacaacttcgtggtaagttaatgcaacaagcagttccggaaggaacaggtgccatgtacgcaattataggtttagataatgaaagcattgttcaagcttgcaaagcgtctgaacaaggtgagattgtgtcagcggtaaactttaattcaccgggacaagtggtgattgcaggagcaaaagtcgcagtagaacgtgctgctgttgcttgtaaagaggcgggagcaaaacgtgcgttgccgttagcagtcagcgtgccttctcactgtgcattaatgaaaccagcagcagaagaattggcagtagcgttagaaaaaatgacgtttagcatcccacaaattccggttattaataatgttgatgtgaaagcagaaaatgaaaccactaagattcgtaccgcacttgtgcgtcagctttacagtcctgtacgttggactgaaatagttgagaatatggcaagagagggaattgaacttttatttgagatgggacctaataaggtgctcactggattaactagtcgtattgttaaagagttgaatgctaaagcagtcaatgatttatcttcattgaatacagtggaagaaagcttagattaatttatgacaacagaggctgatactaaacagcctattttattgaggagtagatgatgcaaggaaaaatagcattagtaacaggtgctacacgtgggattggacgtgcaatagcagaagaattagcgagcaagggggcttttgttattggtactgcaacaagcgaaaaaggagcggaaagtatttctgcttatttaggcaaacagggtaaaggtttggtattaaatgtcgcagatcaagattcaatagatgctgtattgagtgccattaaagctgaagtgggtgatgttgagattctagtgaataatgcaggaattacccgtgatggtttattaatgcgtatgaaagatgatgactggtttgatattatgcaaactaatttaacgtctatctatcgtttatctaaagctgtattacgtccgatgatgaaaaaaggtggacgcattattaatattggttcagtagttggctcaatgggaaatcccggtcaaactaactattgtgcggcaaaagcgggtgttattggctttacaaaatcgttagcaaaagaagttgcagcaagaggagtaactgtgaatgttgtagctccaggtttcattgcaacagatatgacggatgtgttaactgacgagcaaaaagcaaatattctgacaaatgtgccggcaggtcgtttgggacagccaaaagatattgcgaaagctgttgcatttttggcttcggaggatgcgtcatatattacaggtactacattacatgttaacggtggaatgtatttaccttagtagaaatagggatttcaggctggccaaagataaggcgtaatgttaaaatcctgacatgtggtaatgtagctattgaaacaatcgagttacgttggctgttgcattctacaggttaacataacgtatttatgtttgtgtactgagacaggtatcattgtggtttgaccttgtaaaagtaaaaacagcttgaaacttcataaaaaatacatacactattatatcttatcgctaaccattaataggaaaaaagcaaaatgagcattgaagaacgtgtaaaaaaaatcattgttgaacaattaggtgttaaagaagatgatgttaagcctgaagcttcatttattgaagatttaggtgcagattctttggatacagttgaattagtaatggctttagaggaagaatttgatattgaaattccggatgaagaagctgagaaaattacaacagttcaatcagcaattgattatgttcaaaataatcaatagtaatgatacttgaaaattacacatgaaatcagtataatccgtattcacttatgaccctttgagagggtcatatttttgtgtggcacattgtgcttgtatgaaatggggagctgaaacggcgttattacccgcaaagaggaaattaaaaatggcaaaaaaagtccaagcatacgttaagttgcaagtcgcagcaggtatggctaacccatcaccacctgttggtcctgcattaggtcaacaaggtgtgaacatcatggaattctgtaaagcatttaatgctcgtactgagagtctagagaaaggtttaccgattcctgtcgttattactgtttatgcagaccgctcttttacatttgtgactaaaactccgccggcagcggtattattgaaaaaagctgctggaattaaatctggttctagtaaacctaacaaagataaagtaggtaaagtcactttagatcaaatccgtcaaattgctgaaactaaagcagccgatatgaccggtgcaacaattgaaactaaaatgaaatctattgaaggtacagcacgttcaatgggtttagtagtggagggttaatctaatggctaaacttactaagcgtatgaaagcaatcaaagccggtgttgattcaacaaaacaatatgaaatcaatgaagctattacggtgttgaaacaattcacttcaacaaaattcgttgaaagcgttgacgttgcagtcaatttaggtattgatgcacgtaaatcagatcaaaatgtacgtggtgcaaccgtgttaccacatggtacaggtcgttcagtacgtgttgctgtgtttactcaaggtgctaatgttgatgcggctaaagcagctggtgctgatttagtaggaatggaagatttagcagagcaaatcaaaaagggtgaaatgaactttgatgttgttattgcttcccctgatgcaatgcgtgttgttggtcaactaggtcaaattttagggcctagaggcttaatgccaaaccctaaagttggtaccgttacaccaaacgttgctgaagcggttaaaaatgctaagtccggtcaaatccgttaccgcaatgataaaaacggtattattcatactacaatcggtaaagcaaatttctctgctgaacaattaaaagaaaacttgcaagcattattagctgccttgactaaggcgaagcctgcgacagcaaaaggtatctttattagaaaagtaagtgtttctactactcaaggtgcaggcgttgctgttgatcaaagtagcttataattaatgtagccaaacctttacagaggcgtattttgtatatataatgcacgcctctattttgccttatagcataatttctggttggtgcttgacctctcaagccccgtccaagaccgtaggggaaagaatatttcttaataatcctacgtagatggtgatacagaataagaatttttcttgcttctgtgcaccttagcctcagagaagactgcaaaagtgcggtgtttttttgagaagttttataattccgatcaatcggagtgtattcaggagctaaaagccaatggcattaaatcttcaagacaaacaagcaattgttgctgaagtaaatgaagcagccaaaggtgccctatcggcagttattgcggattctcgtggtgttactgttgataaaatgactgagttacgtaaagcagctcgtgaagctggcgtttctatgcgtgttgtacgtaatactttattacgtcgtgcagtagaaggcacagcttttgagtgcttaacagatacgtttgtaggtccaacacttatcgcattttctaatgagcatccaggtgcggctgcacgtttgttcaaggattttgctaaagctaacgataagtttgaaattaaaggtgcagcctttgaaggtaagatccaaaatgttgagttcttagcaacattaccgacttacgaagaagcaattgcacgtttaatgggtactatgaaagaagcagcggcaggcaaacttgctcgcactcttgcggcataccgcgacaaattacaagaagcggcttaattaaagcctttcttaactcgtttaatttatttactttaggaattgattgttatgtcattaactaacgaacaaatcattgaagcgattgcttcaaaaactgtcactgaaatcgtagaattaatttctgcaatggaagaaaaatttggtgtttctgctgcggcagcagcggtagcagtagctgctggtccagctgaagtagctgaagaaaaaaccgaattcgatgtggttttagctgaagctggtgctaataaagtagctgtaattaaagcagtacgtggtgcgactggtttaggcttaaaagaagctaaagacctagtagaatctgctccggctaacttaaaagaaggtatttctaaagcagaagctgaagcacttaagaaagaattagaagaagctggtgcgaaagtagaaatcaaataattttgattttttcaatcttctagttcagaaaagacttggtggacaccccaaggtcagaataataatcctaccttttcgtgctttttcgaaggtgggattattcttttttatgctgtcgaagagtttatttgtagatgatcgtaatttgggagaaaaactttacttttgtctgcagtgggttgagtgcggtttgttttaagccgcactttttcgtttcattcgcaatgagattttttattttaagaacgtttcataacttcaaaaaattcttcattggtttttgccatcattagcttatcaattaagaattccattgcctcaatttcacccattggattaagaattttacgtagaatccacattttttgtaattcatctggtgtagtcagaagatcttctttccttgtaccagaacgattgaagtcaatagcaggaaatacacgtttttctgcgattttacgggaaagatgcaactccatattcccagttcctttaaattcttcaaaaatcacttcgtccatttttgagccggtatccacaagtgcggtggcaataatggttaaactaccgccttcttcaacattacgggctgcaccaaagaagcgttttgggcgatgcaatgcattggcatctacaccccctgataagatttttccggaaggcggtgttaccgtattataagcacgagctaagcgagttatgctatctaataaaataaccacatcttttttatgttcaacggaacgttttgctttttcaatcaccatttctgcaacttgaacatggcgtgctgccggttcatcaaaggttgaagcaatgacttcgccttttactgagcgttgcatttctgttacttcttccggacgttcatcaatcaacaatacaattaattcacattccggatagttatgaataatactttgtgcaatattttgtaacaacatggttttacctgcttttggcggagcgacaattaaaccacgttgtcctttaccgataggggaggctaaatctaaaatacgagcagtcaaatcttccgttgaaccatttccacgctccattctgaggcgtgaatttgcgtgtagtggagttaagttttcaaagagaattttactacgtgatacttctggtttatcgtcattgactcgatcaacttttagtaaggcaaagtaacgctctccttcttttggtggacgaatttttccttcaattttgtcgcccgtttgcaggttgaaacgacgaatctggcttggagaaacgtatatgtcatcaggaccggctaagtaagaactatcggcagaacgtaagaaaccgaaaccatcaggtaaaatttctaatatacctcctccaaaaatgtcctctccacttttcgcatgttgttttaaaattgcaaaaataatgtcttgtttgcgtaaacgagctaaattttctaagcccatttgtttttcacctaattctacaagttcagaaacaggtttatttttaagttctgttaaatgcataataaataattgagaatgttataaaaatgaattgataaatgaattgaatataaatatgaaattgcgtgcaaatttatcattaaatctttaagttgtctagctatctaacttaaaaatcaataaatgtgcggacattttttgaggattttttccgttcatgttattatcacccaaattctttactgataatttttatgcaaaatagtcatctttcacaacaacgtttttctgatcttgctttacattgtagcgtgcaacaagcgataaaagaaaaaggctttgagttttgtacacctattcaggcattgtctttacctatcactttaaaagggcaagacatagctgggcaggctcaaaccggcacaggaaaaacgatcgcatttttaactgctacatttcatcatttgctacaaaaaaacaatataaattcctcagaacaaccgagagcgttaattttggcaccgactagagaattggttgtacaaattgcaaatgatgcgaattttctggttcaagcaacagggttgaaaactggcttagcttatggtggtgagggctatgataaacaattaaaggtaattgatcggggtattgatattttaattggcactacagggcgtgtaattgattatgttaagcaaggaattattcgtttagattatattcaagtggtagtgttagatgaagcagatcgaatgtttgatttaggttttattagagatattcgttatttattacgtaaatgtccggtgcctcaacaacgtttaaccatgcttttttctgcaactttgtcttataaggttcgtgaacttgcttttgaacatatgaatgatccacagtatgtagaaattgaacccttacaaaaaacggggcatagaattagagaggagttattttacccttctaatcaagataaaatggcattgttgatgactttattagaagaagaatggccagagcgttgcattattttttctaatactaaacatcgttgtgaggaaatatggggatatttaagtgcggatggtcatcgagtaggattattgaccggtgatgtaatgcagaaaaaacgcttatctttactcaaacaatttacggatggaaccttagatattttggtggcgacagatgtggcagcacgagggttacatattccggatgtgactcatgtgtttaattatgatttacctgatgattgtgaggattatgtacatcgtattggaagaacagggcgagcgggtgaaagcggtatttcaatcagttttgcttgtgaagaatatgcgattaatctgcctgcaattgaagaatatattggtcatagtattcctgtcagtcaatatgatgcgaaagcattgatcgaagatttgccaacacctcatcggattaaacgaggtgcatttgatagccgttcgaatttacaacgtactgtaaagagattgaaaaaaacttattaatttaaccgctcttttatgggagctttgccaagataagcaaatatccctttaattaccggacgataacgttgtacactaatacggaattttcgactaggaatagagagataaaaatgacaccttatttaattgctccatctatactttctgctaatttagcacgtcttggtgaagatgtagaaaatgtgctaaagagcggtgctgatgtaattcattttgatgtgatggataatcattatgtaccaaatttaacctttgggcctgcgatttgtaaggcattgcgtgattatggaattaaagcacctattgatgtacatttaatggttaaaccggtagatcgtattattcctgattttgctaaagccggtgctgattatattacatttcacccggaagccagtgaacatatcgatcgttctttgcaactgattcgggattgtggttgtaaggctggtcttgtttttaatccagcaacaccattgagttatttagattatgtattggataagattgatgtgattttgcttatgtctgtgaatcccggatttgggggacaagcttttattccaagcacattagaaaagttaaaacaggctcgtaaaattattgatgaaagtggcttggatattcgcttagaggtagacggtggagtaaaagtgaataatattgctgaaattgctcaagctggagccgatatgtttgtggcaggatctgcaatttttgatcagcctgattataaaaaagttattgatgaaatgcgtcagcaactttctacaataagagagaaggaaacaaaatgacacaatttaaattaattggttttgatttagatggtaccttagtaaacagtttgcctgatttagctttatcaattaactctgctttgaaagacgttaatttgccacaagcatcggaaaacttggtgatgacttggattggcaatggtgctgatgttttgagtcaacgtgcagtggattgggcttgtaaacaagctgaaaaagagttaacggaagatgagtttaaatattttaaacgtcaatttggcttttattatggcgaaaatctttgtaatatcagtcgattatatccaaatgtgaaagaaaccttagaagcattaaaagcacaaggctacattttagcagtcgtgacgaataaaccaactaaacatgttcagcctgttttaactgcttttgggatcgatcatttgtttagtgaaatgctggggggacaatctttaccggaaattaagcctcatccggcacctttctattatttatgtggcaagtttggtctgtatccgaaacaaattctttttgttggcgattcgcaaaatgatatttttgctgctcattctgcaggttgtgctgtggttgggttaacttatggttataactataacattccaattgcacaatcaaaacctgattggatctttgatgattttgctgatattttaaaaattacacaataaggataaaaaatgacaaaaccggttgtattaagtggtgttcagccctcaggtgaattaactattggtaactatttgggtgcgttgcgtcaatgggtaaacatgcaagatgagtatgagtgtttatattgtattgtagatttacatgcaattacagttcgccaagatccggacactttacgtaaagcaacgttagatgtattggctctttatttagcctgtggtattgatccaaagaaaagtacgatttttattcaatctcatatacctgaacatacccaattggcatggattttaaattgctacacttactttggtgaaatgagccgaatgactcaatttaaggataaatcggcacgtcatgctgacaatatcaatgtaggtttatttacctatcctgttttaatggcggcagatattttactttatcaagcaaatcaagtaccggttggtgaagatcaacgtcaacatttagaaattacacgtgatattgcacaacgttttaatgctctttatggggaacattttattgtgccagaagcatttattccaaaagcaggtgcacgagtaatgtccttgttggaacctgagaagaaaatgtctaaatcggatgaaaatcgtaataatgtcattggtttgttagaagatcccaaagcagttgtgaagaaaattaagcgagctgtaacagactcagatgaaccgcctgttgtgcgttatgatgtaaaaaataaagcaggtgtatctaatttattagatattttatccggtgtaacaggaaaatctattgtccaattggaagctgaatttgaagggaaaatgtacggacacttgaaaagtgcggtggcagatgaggttgctactatgctgactacattacaagaacgtttctatcatttccgtaacaatgaagaattattaaataaaattgcggctgaaggtgcagaaaaagcccgtaagcgtgcaaaggaaaccttagataaagtttatcgtgcaatgggttttgttactccataaaaacgatttttcccctaagtatttaggggatcttttttcttattgtaatacattttcgaaaaaaacagtatttgcagtagggtcacttaatgaaaatagtaagaactttccgaaaaaccgccgttattacaaaccacagaaatctgatactgcgtatagaataagagaaaaatcttctatggcaaaaaatagaaaagcaagcatttcccacgtgacattattagggtgttaaaatccaaggttgtgctaatgaaagagaataaatattagcgatgaaatgagattgttcttctttgggaacggggaagggaataaaggttaatagttcttggtgtaatttcaaaatttttgtaaaacagaccgctctttcgatctctgaaaaaaaatctgggtttaatgctttagccacatatcctctttttattctgcctagtgccatagctaaatgaatgagtaacatgtctacttgtttcgtttttaaatttactcgccattttttaccaagacgatttcggatattaagagtaattgtcataatatcttcatcaattaaatggcgttgaactaaaaaaatcagcctttgctgtattaacatgaatttcattccattatgaaaaggatagtttactttacctgaaataaacacaattaagtagtgcatagatcacaactttgtaggaaaataaacaaaattttacacgataggaattaagatgttaaacaaggaaattatcgcacgatatgaaggattaatttttgatatggatggcacagtaattgatactatgccttgtcataaacaagcttgggagcttgttggtgctgaaatgggctatgctttggatggagatgttatgtatcaattggggggagctccggtaagaactattgccaaagccataatggaaaaagcacaaatgccgttatatttaatggaagatgtgattagtttaaagcgtaaatatggaattgaattaatcatgaaaaatgctactttattgcctgctgcggatattgtgaaacaatatgttggacaaaagcctttagctctcggtacaggttcacatcgttacgtcacggaaatgcttttagagaaatttcaattgcagtcttattttggtgctattgtgacagcggaagacgtgattaatcacaaacctgagccggatacatttttgcgttgtgcagaattattaaatcttgatccgttaaaatgccttgtatttgaagatgcggatttgggcgtacaagccggattagcggcggaaatggatgtttttgacgttcgtgtaaatcaaataattacaagcaagtgattagattttatctgtattttgtgtaatctgaacatttaggcagggtagagaaatagttgccaaccttatttttcattatgtttgtagcttttatttaaaaaatactttatgaacataaagttgtgctttttttatccgttatgattatttaacgtttgctttaactctttaaaaagacccttggttctatttattgtcctttcaatatctaactcagaatatttctcgaaagtaaatagataattgtgatattgctttaaactagtataagctacttttattggcaaaacagttgtttattcatttttcaaaaataaagcttaaagccttgtgctataaggctttaagctggtttttagacaactattttgtctgctttagaatttataatttacatttaaaacaaatgtgcgtccttttgaatagttgtttaaggctttctggtatccatcgcccacgcccatagcataagtcatttggtttgccgagtcgttattcgcatctagcggattaatgtattttttatcaaaggcattttgaatttcgcctttaatagttaagttttccgttggttggtagatagtgtaaaaatcgaaaattattggctgtgctttgatttcttccgtgccgctaattcttacataagtaagaaatgtctcgccagtcttcctagaagtaaaagttcccggcaagataacatcgccatctgctttatcaagtctggctcgtttgcttttaccatagtatttagcagtaccgcctaatgttaattttccgtcaaataaacgtgttcctaggtcaagggaaccgtaatctttcggtagagacgatattttacttaagccgaacccttgtaaatattgtccggtttcactatcgtcccccacgctattactggaatcagaatatgaacttggctgattggttttttgtctggcataggataagttggcatagaaccaaccgatatcataatttaattcaagttccaacccctgaattttaacaataggtgatgaatcagcaggaatgagttggtttaaaggaacttttgtttttccacctcctgattctaccatttctgttttcaagattgttttgccaccttcatagttaatatgcgtaagatgcccaacgcagtcataaatagtcggtgctttatctgctcctctccacgcgtttgaactacattcttgtttgatattgataatataatctctgatttttgtttggtacgctaaaatcttaaagcctagtgcatcaaaatccgagaatatcccatttttataaccgttaatgccgaattgaatggttttggctttttctgattttaaatcgggtcttatggctaatgtaccaaattcggagaaatacatctctttgatattcgggacccgatgggttttggcataactcacaaatggcgaaaagagcgggtgaaaatccgccgagaaagacatagaataattatcatgagatcttgaatttcccttgtggacagagtagaaacttgggcagttataaacatcccaagcactatagtcatcactaaaaccagtataacaccccaatttttctgctccctcaacaccatacttcgcaactatctctgatgagttggaatttacccaaactggcaatccattcttcatttttttatgagagtcatgccatgtcatatatgaaaatctatccttaggatcaagagggaaaatcctaccttcatatttatagatttggcgattggcattgacttttaaggtataaatatcgtatttaaaggtttggtcaaaatagagggttttaaaacgttgttcgccgtcgggttggaacgtattcgatcttatgccgtgatatttacatgcgtttttatacttaccaacctcatcacaagcataaagtgaattaggttccccaccatcaaaataataacctaattcacgaggatgtcgatttttactgtatttatttttgaggatattggcacctaatgttgcttcataagagaatttttctgtgaatggaatagaaaaatgcatatttatatccgtggttttcgcactatttttgctttccaacacatctttcagctttttaccattaaacacgcttcccttgtgataggtttgcgtagaggtattatccgccaagattaattcaaattgtaaattctctttcggttttagttggtagtttaactggtagtttttattctctaaatttctgccggaaagtgcggtcgataaagagcggtatgacaggatagctttattatatttatcgttatattcgattttggctaaatggctttggggatagtggagtaatttgcttgggtcatagggttgtaatccatagagttttcgtttttcatttctgtcacaaaaagsctcacctttacaagcttctttaactattcttcccacttcttcagcgtcaacatcttttatacttctacccccccccactttaaaatcttgcgagcttttacgccaactataggcatacataaaacctaatgttcttgtatcggaaaaaggatagcgaaaggcaaccgcacccatataattcggtccggttgcattggttcctccgccaacatttaataaagcacctacatttctgccttcacttatcacatcatcaacaccaattgttctaaaatttgccgaacctactagagcattagcccccgctttaccgtcaaaacttcctcgttgaatatctacactggtaataaacgcagggtcaatggttgcaccgaattgagaggttccaccggctttttcgctgttatctcctgatgtggcaaaaaaggtttgcgaaataccgtctaccatcgtattcacacgaccgaatcctgtttgacctcgaacgttcaccgacactgtccccgaactcttatcaaggttggtaaacgcacccggtaccgttctgatgatgtcatcaatagactgcgttgacgtggaaatattttctctcacactggtcgctcccgcttttttaaagacttcctgtttaggtggtagcttatattctacgttaatttgatcgagcatttcttctgcataaacacaagtgcttaatacggaaaaagctaccgcagtgagtttaaatttattagtcatcatttttatcctagttatttatgattaaattcatggtgtaaacatgtacgaccagttatataaaaatatcctgtgtatgtcaattaatgataataatttttattattatttttagtttatgcggaaattcagcatgttatcaaaattgatattcgccagcctgaaagccagagtttggctctggcggaaaacatgctttagttaaaaatgattcggaggaaatgcggtctattttttacaaagatttatctttaataaaaggaaactgaatgcgatattttatcgccagcattctgatgagtgtacaggttataattgccagccatggacttagcaaaggggaaattaaaccggttgaacccaataattctattgtcgcaccgacaattgccgcactggcatatatttcagattgaaaaattaacggcggttttgccgtcaatatgtctcggatacaaccaccgcccactgcactgatacagcccaaaataatggataattgaatattttccgttagataccatgttttatttgcaccgaaagctgcaaaaaaacctaatccaacggcatcaagtaagttgctcacctttgagaacgacgttattttttcttgaaaaaaagatacgcaacacacggctaaaaggataattaatagataggcgatattttccaagcctgccggcggtgttgctgataggcataaatctcgaataattccaccgcctatcgctgttactgctgagacaacaaaaacaccaaataaatcaaattgtttcttcacgccagcaaccgcaccacttaaggcaaagataaatgtaccgagaagatcaatgaaattaaatacggataacataaaataccttaatcttaattttaaggcatcattctagcataacgaaattaaaaaaaaacttcgcagatgtaatggacacaaaaggattctatacattaatgaagcaaagtgtacatttgtacattacatcagcatagttgttatggtaatctagaagaacaaagtgtgttgaaaaaagagattcttggcgtaatgccgattttaatatttaaacgaaatatcctaagttatggtgaagaatatgataagtaatttaaccgaacagccttctggtgctgagtaccttaaagcaattttaagttcaaaaatttacgaacttgcacaggttacacccttacaacctatgctcaaactttctgagcgtttaagtaataccgttttagttaaacgtgaagatcgccaattagttcatagctttaaattgcgtggtgcttatgccatgattgccggtcttagccaaccgcaaaaaaatgccggtgtgattaccgcttccgcaggaaatcatgctcaaggtgtcgcactgtcagcgaaaaatctgggattaaacgcattgattgttatgccgcaaaataccccccgcattaaagtagatgcagtgcgtggttatggtggcgaagtgcttttatatggtgcaaactttgatgaggcaaaagcaaaagcgatagagctttctgaaagtaaaagtatgacatttattccgccttttgatcacccggcagttattgcaggtcaaggttctttagccatggaattattgcagcaaaacagtcatattgatcgtatttttgttcctgttggcggcggcggattagcagctggcgtggctgttttaattaaacaattaatgcctgacattaaagtgattgcggtagaaagtaaagattcagcttgtttacacgctgctttgaaagttggccaaccagtagatttagagcgtgtcggtttatttgctgacggtgtggcggtaaaacgtatcggcaatgaaactttccgtgtatgtcagcagtatattgatgatgttgtgcttgttgacagcgatgaagtttgtgcggcaatgaaagatatgtttgaaaatgtgcgggctattgcagaaccgtcaggggcggtgtcattagccggcttaaaaaaatatgtcaaagaacataatattcaaggcgaaaccttggttaatattttgtccggtgcaaatttaaattttcatacattacgttatgtttccgaacgctgtgaaatcggtgaaaaacacgaagcaatttttgctgtaactatccctgaagaaaaaggtagtttcctacgtttttgccatctgttaggtgatcgccctgttaccgaatttaactatcgttatgctgataaagaacaagcctgtatttttgttggtgttcgtattagtagtgaaaaagaaaaattagaaattattcaacaacttgaacaaaatgattataaagttatggatctctctgatgatgaaatagcgaaaacccatattcgctatatgattggaggacgaacaaccagcaatagcaaagagcggttatatagcttcgagtttcccgagcaaaaaggcgcattattaaaattcttgatgatgttaggtacgcattggaatatttctcttttccattatcgtgcttatggtgcagactatggtaacgttttggcaggctttcagttagatgagcatgatgaaattcgtttcaacggtcatttagaagaacttgcttatacttatcaagatgtaacggatagcccagcttacaaatatttcttagcttgannnnngatgaaatcaaaaaatgccatattaaatggcattttttctactcaactttgttaattcgcaactctttcggcacttcaaaaacggtattttcttcgcaaccctcaagctcttccacttcatcaacacctaattcttttaaacgggaaatcaccgattgaaccaatatttccggagctgaagcaccggctgttaagccaataactttcacattatttaaccaactcacctcaatatcatttgcatcatcaattaattttgcagtaactcccattcttgaagcaagttcagctaatctattggaatttgatgagtttttagaaccgaccacaataactaaatcggacaattcggctaattcacgaacggcttgttgtcgattggttgtcgcatagcaaatatcatttttgcgaggaccttgaatggccggatatttttgttttagtacctcaatgacatcggcagtatcatcaattgataatgtggtttgtgtcataaacgtgatgtcttcatcattccgtaaagtcagtttggcaatatcttccacatcttctactaaataaataccgcccttatcgttatcatattgtcccattgtgccaataacttcggggtgtccttcatgcccaatgagaatggcttttgttcctttacggctggcacgagcaacttgcatatgcacctttgtcactaaaggacaagtggcatcaaatacttttaaattccgctctttggcctcttgacgaacagcttgcgaaacgccatgtgcagaaaaaattacaatagcaccgttaggcacttcgtctaattcttctacaaaaattgccccacgatcacgcaatccatccacaacaaaacgattatgtacaacctcatgacgcacataaataggtgctccgtgaatttctaatgccagctccacaatactaatagctcgatcaacaccggcacaaaaaccacgaggattagccaaaatgattttcattagttctgcttgctctcttttttatcgttttgcttaaaagcatcaatagccaataatccggcaccaatacaaattgcaacatcagcgatattaaatacggggtaatgccattgtttccaataaaaatcaaaaaaatctaccacaaagccatgataagctctatcggctgcgtttgccaaagctccaccaaccattaacgcatagcctgtattttgtagtttctgtgttgcttgatttttatataagaaaaataaaatcatgaaggaaacgactaaagccaataaaataaaaaagtatttttgccaacctgcatggtcagccaaaaagctaaaggctgccccgtgattacgcacgtaagttaaattaaagaaaggcaatatattaatactttcgtataaagaaaaattttttactacagcgagttttgttattaaatcagtaaaaaaagcaaccgcacttatccaaagaaatggaagtcctgtttttgataaattcatatggtttccaatagatgaaaaacgggcgtaatataacacccaatttaaattatcttgcgattaaacgctcgtgcgttctgtttcgcaggatctactttgatagccgttattgtaaaatcttaaacatctctctaacggcggaaggattatatcttactttataccttatatccacgctctgaaagacggagatttacggcacgttgcgataaaattaaattctatgtgagtttagttcgattattctgttgtattttaaccgctcttttccagcaaaattgaataaattagaggataaaatttatttacttatattgccattgtttggaattttctctagaatttgagaaattttaaccccaaaacagataggtaatacaaaaatgaagaaaaaaatcacttttactaaatctctcatcgcttcagcgttggcattatcagcgagttatgtcaatgcgtctgctttccaactcgccgaggtatccagttccggtttggggcgtgcttatgcaggtgaagcggcaattgctgataatgccgccgttgtagcaaccaaccctgcattaatgagtttgtttaaagcgaaacaattctcatggggggggggtatacgttgattccaacattaatgtaaacggaaaaatagacgttagcacatcaccaattccttcttctcctgatattctaaatgttaaagccaatcaaaaaaatatcgtcccgaatacctttattcccaatctgtattttgtaacccctattaatgataaatttgccatcggtgcaggcatgaatatgaactttagtttgagaactaaatataaagatgattatgttggcggtgttttgggtggaacaagcgagatggattctattaatttgaatttaagcggttcatatcgtgtcagcaaaggattaagcgttggtgcaggattaaatgccatttatgccaaagcgaaatttgaacgccgtgcagggattttaaagaaaactattgatagtttacgtagtgatgacaatgagctgcttattttactctctccatcaatagtatcatcggcatatagcctaacatttcatgaaaacagtactgtagcacgcttacaagataacaatgcatggggattgggttggaatatcggtgcggtttatgaatttaatcaagataatcgtatcggtattgcctaccattctaaagtagatattgattttaaagataatgatacattgggttatatacttggcaaagaagagattaagcttcatcgtgcaaaaggtaagttaactttacatttaccgagctatttcgaaatttccggtttccaccaattaacagcaaaatttgctatgcactacagctataaatatacgcaatggagccgtttacaaagtttgcatgccgcttattccaatggtgaagtcgcttttcataaagatgaaaactttcatgacagttctcgtgtagctttaggggcaacttatgatgtgaatgataaattaactttacgtgcaggtattgcttatgatgaatccgccgaccacccaactgcttccattccggataccgaccgcacttggtacagcttaggggcaacctatcatttcacaccaaatctttctgtcgacatgggctttgctcatttacgcggtaaaaaacagaaatttaaagagaaccactcatttacaagcaaagataattatgaagtaggtagaatagatgcagattatcaatcaacagcacgagccaatctgtatggcttaaatcttaactaccgtttctaacgattatccaattgtttattagttatagaaggcgtattttgatacgcctttttattttttactcaaaacatcataaaatcttaaatgagtaatctaataaatatgtcaagttgcgattttaggaaaatgtcagtattcaatatcaatcaggcaaattgacgttgctctccgttaccttctacgttttcgatacaacgcccgcaaatgtgagaatgttccttatttgatccgatgtctgtagaaaagtgccagcaacgagggcatttttccccatcggcacgttccacttttatcgctaagcctgtcaattcgctttcagctacatcggctttcgacaacggtttcactacgacttgtgaggtaatcaacacaaagcgtaactcattaccgagttgttccagtaatggacgaatttcctcgcttgcatagacggtgactttagcttcaagtcctgctccaattaatttgtcgttacgtgcttgttctaatacacggttcacttcggcacgtacttttaataactgttgccagtaagtatcgtccaatttatcgctttcatctagcccaaacaaaccatcataaaattcctcggtaaagacgaattcagcacgattatccagttttggcaagtagccccaaatttcatcagcagtaaaagataaaatcggtgcaatccaacgcacaagagcttctgaaatatgccataatgccgtttggcaactgcgacgagcaaggctatccgccttagttgtatactggcgatctttgataatatccaaataaaatgatcccatctcaattgaacaaaaacgcattaagcgttgtacaactgtgtggaattgatagttatcataagcttctttgatttcgttttgtgcttctaaagcacaacttactgcccagcgatcaagagaaatcatttcttcagggttaactaggtcgttttttggatcaaatccgtttagatttgctagtaaaaaacgagcagtgttacggatacggcggtaagtgtcgcctgcactgtttaagattttgtgtgaaacggcaatttctcctgtgtaatcagtggacgctacccataaacgtaaaatatccgccccgtttttgttccaaacttcacttggcacaataacattaccgagagatttggacattttccgacctttttcatccaccgtaaaaccatgggtaagtacttgcttataaggtgccttattgttagttgcagtagataacatcaacgaagacataaaccagccacgatgttggtctgacccttctaaatacatatccgtagatttaccgttaaattcagggcgttgctctaccacggaagcataagttgatcccgagtcaaaccacacgtcaagcgtatccggcactttatgataagtttttgcctcttcacccagtaattccgcaggatcgagatcccaccaagcttgaatacctgctttttcaacacgttttgctatgtcttcaagtaattctaacgtgcgagggtgtaactcttccgtttcattatgtacgaacatagtcatcggtaccccccaagtacgttggcgagaaatacaccagtccggacggtttgctaccattttatcaatgcgagcttccccccaacttggaatccaacgcacagatttaatttcgcttaatgcttttatacgcaaatcttgcgtttccataccgataaaccattgtggtgtagcccggaaaataatgggtgttttgtgtcgccagcagtgtggatagctatgtttaatacgttccaatttaagcaatgcacccgtttctttcaatttttccaataccaaatcattggcttcaaatacgcctttaccggcaaagaatggcgttgaagaaatgaatttaccgtcatttgccaccaacccagccatttccaaaccatatttttttgataccacaaagtcatcttgaccgtgatccggagcggtatgaactaaacctgtacccccatcaacggtaacgtgatcgcctagaatcatagggacagaaaaatcgtagaatgggtgattaaagcggataagttctaaatcgccaccttttgccgaacctaaaatttgtatctgctcaattcctaacgcattttgtaccgtttgcactaattctgtcgccaagatgacacgctcgttaccaagttgaacaagctgatattccaattctgcattcactgcaatcgcacggttagacggtaatgtccaaggtgttgtcgtccaaatgatcgcagacaatgctccttgacctttaccaagtgcattgaatttttcttcaacctccgccgcacttaccgccgcaaaacgcacatagattgatggcgaaactttgtcttcatattccacttccgcttcagccagtgatgaagcacaatctaagcaccaatgaacaggttttgaacctttgtaaaggtgaccattttgaatcactttacctaaagtgcggataatttctgcttcagtttcaaaattcattgtaagataaggattatcccaatctcccagtacgcccatacggataaagtccgctttttgaccttcaacttgttcttttgcataatcacgacaagcctgacgaaactctgctgctgaaattttctcgttcggcttacctaccaaaccttctacttttaactcaatcggtaaaccatgacaatcccaacccggcacataaggtgtatcaaagccaagtgcggtcttagatttcataataatgtctttcaaaattttattgacggcatgaccaaggtgaagtgtaccgtttgcataaggaggtccgtcgtgcaaaataaaggttttcttacctttagaggcttctcgcactttttggtataaatttttatcataccagttcttcaacatatctggctcacgtttagccagatcacctcgcattggaaaacccgtttcagggagatttagagtgtttttgtagtctgtcatattaattatttctcaactttataatgaatccaagattgttttcgcactggaatacacaaggataacccattgatttaccgaatttaccaaacgaatttgtccattcagaaattcaaccatccaataatcatcaaaattaatatctgtagtattaatattgcattcttcatttgaccgagcataatctgcaccgcatactacttttgtcggcggaccatacttttggggcaatccatttaaaatatctttcacttcttgtacttcacgtgggaagggcggtctgttttggctataattcaaaatgtcaattgcaatactgttcaatacttgtccattaaaataagcggttgcctctcgattattgccgttaaataaaaaatgctgacatttataagaatttaatggctggtaatattcccaaccggtgcataatttagagtcggcaatttgttgataggtcatgccgaatttaagatctttataaccgtctaaaatgatattttgggcaaaactcaagcagggaataaatgtacccgaaatcagcaacaaattttttaactttttcatgaaatgtcctaacagaatttcttgcattaacataatttatttgcaacaagaaaataagcaaaagcgatttagcattatacgcataaatccttaacggtcaaaggttcaagacttgctgaaaatacttttttgccacaacaacatcattttcaatctgatttttaagggcatttagagaaggaaattttttttcatggcgaattttatggcaaaattcaatttgcaaggattgaccatacaaatcacgatcaaagttaaacaaatgcacttccaataattgttttacgccattgatagtaggtcgcttgccaatgttggcaactccttgaaaaatatcgccattttttaaccgcacttttacaacgtatacacctttaattggattaacttgccgatgtaaataaatgtttgcagtgggaaaaccaatagttcgtcctaatttattgccatgagcaactcgtccataaatacgatatggcttacccagtaacttttctgccaacgctaaattatcttctgataaggcttggcgaatggcggtgctactaatacgctggtcatttaattgtaaacttcgattatcttccactataaagctttgttgttgcccttttttttgcagaagtcgaaagtcgccttctcgatttaaaccaaaccgaaagtcatcaccaatgcttaaaaacttcatcttcagatgtttcactaaacaatctgaaataaattgctccgcacttaattgggcaaaagtgcggttgaatttaacgcagaaaacataatctacacctaactgtgccaaataggcgagtttatctcgtaaacgcataagccttgccggtgcctgatcaccttgaaaatactcataaggttgaggttcaaataacatcactacaacgggcaaattcagttgttttgctttcgcttttaaatgttgcaaaatagattgatgccctaaatgaacaccatcaaaattaccaatagttacagcacaaccctgctgttttaaaggctcgggtaaattatgaaaaccacgaataagttgcataacatcgcctaaaaataaaaatttcttgaaaattgtcgcacattatacgtataaatatacaatggtaaaagaatgcagcataagcttactttctgtttaaaattagaaaacgacaagcataaggatttttctcatctgccggacgttgttgctcaaattcaatctgccattcttgccaattaaattcaggaaagaaagtatctccctcaagttctgtttgaatttccgttaaatataatttatttgcttgaggaaggtattgcttaaataattcgcccccgccaatcaacataatttcatgatgattttctcgcacaaaatctaccgcactttgtagattgtctttccaaataatgccatcgtgttcataaggcgaacgagaaagtacaatattggtcctattcggtaagggacgaccgatactttcaaaggtttttcgccccataatgatgggttttccgccagtattttgacgaaaccaagcaagatcagccggcaaatgccaaggcatttgattatttttgccaatcacatgattttttgtcatagcaacaattatacttagtttcatttactttccttcttccttatcaaaaatcaaaaaagtttatcagcgagagtgactatactacaggtttgtgtcgataaaacaataagccgggtaatgctaggccaaaaacaagtgctccaatgaggaaacctgttttgagaaaatattccgtcatttgtgctacacgttgttcattgaaaccataatgatgcaaatgaacaattgcgatcatggctttataagcgaaaacgcctgggatcattggaataaccgctgcgacagtaaaaactttcgggtgagccaaataacgatgcgataaatatacgccaataaacccaaccacactggcagctataaaagtcgcaaaaactaaaggaatatcgaaatgtactaagaaagttcttgtcccatgccccaatgcccccaaaaatgcacaatattttaaaacattcttaggtacattaaacactaaagcaaatccgacggcaggaatagctgcaaaaaacatatcatctaataactttaagataaggtccatgattaacgcccccaattggcaatatgtaaaaaacttagtgcaaatacaattcctaaacaagtaccaaaagttaatactgttgccaaagtccaacgtgcaattcccatattaatatgtccttttagaacatcggcaagcgaattaatcaatggaaaccccggtaccaataacaatacacttgatgctaaggctatttgcggatcattacctaattcatatttaacagccaaacccgccaccatagaggcaacaaaagcggttatagcaaaaacaatcaaaggattataatgacgcaaagttaaagtttgacgaataaacatagcgatagatgaggcgataaatgtgattaaaaaaacgattatatctccaccagataaatgggcaaagcaagcacaggacaatccgatcatagtaacaactacaaaacgattgtattttaaaggcttaataccatctaattttttgcgaatctgttgcagatcatatagtcctttttctgccataattaccaagcgttgtacctctgttaccacttgcatattaatgcctttatcaaggtttttgcgtaccgtagtaatgcaattgtgatcatataatgtagtaataatgacggcattaggtgtcagtgcacattccacactatctattcccaatgcaaaacctaaacgttgtgccatttgtacaatcaatgtactttctgcaccatgctgtaataacatctgtgcaacttgtgcacaagttcttgttatttctcgttgtcgaaatgagctattatcctctgtagtattcataaaaacacctcattctattaaaaaagatgaccgcacttattatatgcctttcttctgtatcaattttgttttaaatcataaaacagcaatgaaaatcgcatgatttttcctaactttaatggtaacttatggggaaatttttcaggtaaagacaactatggaaacacaaaaaacaaataaaactattgtggtaaaatttggtaccagcaccttaacgcaaggttcatcaaaattaaatcgccctcacatgatggaaattgtgcgtcaaatcacacagttgcatcgatcaggctttcgtataattattgttacctccggagcgatggcagcggggcgacattatctcaatcatccgcaacttcctccaacaattgcctcaaagcaattactagcagcagtaggacaaagtcaactcattcaaacgtgggaacaacttttcgctatttatgatattcatattgggcaaattctgttaactcgagcggacattgaagatcgtgaacgttttatgaacgcaagagatacgttacatgctttattagataaccgaattattccggtaattaatgaaaatgatgcggttgcaaccgctgaaattaaagtgggggataatgacaacctttctgcattagtggctattttggcacaagcagaacaactctacttgctaacagatcaacgtggattatttgatagtgatccaagaaaaaatcctcaagcaaaactgatttccatagtcgataaaattactgatcatatccgctctattgccggaggaagtgggacaacgttagggacgggaggaatgacaacaaaaattagtgctgctgacatagcgactcgttccggtgttgaaaccattattgcaccgggtaatcttgaaaatgtcattgtcaatttggcttatggaaaagacatcggcacaaaatttgttgtgcagacagatcgcttggaaagccgtaaacagtggatctttgctgcaccggttgcaggtatagtaactattgatgagggagcggaaagtgcggtattgattcagcataaatctctattacctgcaggtattatcagtgttgaaggatgtttttctcgtggtgaagttgttaaaatttgtggttcgaacggtaaaaaaattgctttgggcgtacctcgctataacagcgattctctcatacaaataaaaggaaaaaaatcgcaagatattgaacagatcctcggttatgaatatggttctgttgctattcatcgtgatgatatggtcgtttattaatcagaaagtttttatcctgataaaataacaaccagcttgtcaaaagaatgtgtttagactactaaatgaagagcaaagacttcatatacttttgaagtcatatatgaataaaaacccagcaaatgccgggtttggaaaagagatataaaattaaaagaatttaaccgtttgctttctcaacttgactgaattcgagttcaaccggagttgctcgaccaaagattaaaacagaaactttaagacgccctttgtcgtagtccacttcttcaaccgtaccattgaaatcggcaaacggcccttcagtaacacgaatttcttcaccgggttgaaactctttgcgatgacgaggtttatctgcggtttcttgtacacgattaagaatacgttcggcttctttttgtgaaataggtgccggtttatctggtgttccaccgataaatcccatcactcgtggaacactacgaactaactgccaagtatagtcattcatttccatttgaactaaaacataaccagggaaatatttacgctcacttttacgacgtttaccaccaacattttcaactacttcttctgttggaactaatacttcaccaaactgttcttccatttgatgtaatttaatatattctcgtaatgtcgcagcaacacgaccttcaaaaccggaaaatgcttgaaggacataccagcgttttttggctgtattttctgtcatattagaaccttaaatccgttaaaaatgtaattaatgaaacgataaccgaatccaatccccataaaattaatgatgctattacagtcacagcaaatacaattaatgttgtttgcattgcctcagggcgagtaggccatgtgattcgtctcagctcaatacgagaatcggaaaaaaatcttctggctttcataccttgattagtaatagcggcgatacctaaagcaataagtaaagcaacaacaatacccacaacacgaagagctgttgaaaatttttctactaagtaaatattacttacagccgccacaataacaatagcaaccactaacaaccataaaaagccattcagacctttcgatttctgctcaatttccggagctgctttattttttgtaatttctaatgccataaattagtccatcatttaattttatactggaatcctatttgaacgagcaattctagcactttcttattttattgcctatcaaaaaatataaattacgtgctatttttaatcttaatgaaaaagggatctataagatcccttttctgtcgaaacctatacaaataggaattcggtattacttaatgatcttagcaacaacacccgcacctacagtacgtccaccttcacgaatcgcaaaacgtaaaccttggtccatcgcaatcgggtgaattaagcttactgtcattttgatgttatcgccaggcatgaccatttcaacaccttccggtaattcaattgtaccggttacgtcagtagtacggaaatagaattgtggacggtaacctttgaagaatggagtatgacgtcctccttcctcttttgacaacacataaacttctgattcaaagtctgtgtgcggtgtaattgaacccggtttcgctaatacttgaccacgttcaatttcttcacgttttgttccacgtaataatgctccaatgttttctcccgcacgaccttcgtctaataatttacggaacatttctacacccgttaccgtggtttttgttgtctctttaataccgacaatttcaacttcttcaccagtacggataataccacgctctacacgtccggttactactgtaccacgtcctgaaattgagaaaacatcttcaatcggtaataagaacggttggtcaatcgcacgctcaggctccggaatatagttgtctaagtgagacgctaattcaagaattttttcttcccactcagcaactccatttaatgcttgtaatgctgaaccacgtacaattggtgtgtcatcgcccgggaagtcgtattgagaaagtaattcacgtacttccatctcaaccaattccaataattcttcgtcatctaccatgtcgcatttgtttaagaatacgatgatgtacggtacacctacctgacgacctaataagatgtgctcacgagtttgtggcattggaccgtctgttgccgctaccactaaaatagctccgtccatttgtgccgcacctgtaatcatattttttacatagtcagcgtgtcccggacagtcaacgtgtgcgtagtgacgtgtcgctgtatcatattcaacgtgtgaagtgttgatagtgataccacgtgctttctcttcyggtgcgttatcaatttggtcaaatgcacgtgcygcaccaccaaagtgtttggataatacagtcgtgattgctgctgttaaagttgttttaccgtggtcaacgtggccgattgtacccacgtttacgtgcggttttgtacgttcaaatttttctttagacattgagagtccctctaaaaaacacggttatcgatggtacaataacaccacattaacctaatgtatgatttacggtttaattaaaaggatagttgaaacaagaagtggtgctgataggcggatttgaaccgccgacctcacccttaccaagggtgcgctctaccaactgagctatatcagcgcctggagcgggcagcgggaatcgaacccgcatcatcagcttggaaggctgaggtaatagccattatacgatgcccgcagtccataattcaactgtcccatcagaattcattattaagaatggtggagggagaaggattcgaaccttcgaaggctgagccggcagatttacagtctgctccctttggccgctcgggaatccctccacgcaaaaatgaatacttgtttactttagaatggtgccgactaccggaatcgaactggtgacctactgattacaagtcagttgctctacctactgagctaagtcggcatcgtaagcaagtgaggcgtattatatggaaaaaattacccctgacaagtcttttttcgaaaaaaaaacactttttttattattcgattaataatcaggcaaaatatataaaaattgtgaaaaaaacagttgatttagtctctttccagatacttgttttagcatttataatgtatatttttatctctttctgtcattttaagtagaatttatcgtggaagaactcaacactattaaactttctgaccacttaacgccttttttaacttttaatcggcaacagtgggctgaattgcgaaaatcagtacctttgaaactaacagagcaggatttgaagccactattgggttttaatgaggagctttctttagaggaggtgagtacaatttacttacctcttgctcgtctgattaattactatatagaggaaaatttacgacggcagactgtcctcaaacgttttctcagcgggcataatcctaaagtaccttatatcattagtattgcaggtagtgtgtcggtgggtaaaagtacatcagcccgaattctacaatcgctattggccaattggcccgttgcaagaaaggtagacttaattaccactgatggatttttatatccactggaaatattacagaagaaaaatttgttgcaaaaaaaagggttccctatttcgtatgatactcagcgattaattcgttttttagctgatattaaatcgggtaaaaaaaatgttaaagcaccaatttattctcatttaacctacgacattatacccaaccaatttgatattgttgatcgtccggatattttaattttagaaggtcttaatgttttgcaaattgggtctaataaatcaaatcaaatgttcgtatctgattttgttgatttttcaatttttgttgatgcagaggaggatcaattaaaagaatggtatataaaacgctttctaaaattttgtcgcagtgcttttacagatccgaattcttactttaaacattatgccaacttatctgaacaggaagccatcgaaaccgcaagtcaaatttgggataatattaatggcttaaatttgaaacaaaatattttaccgacaagagaacgagcgaatttaatcctaaaaaaaggagaaaaccacaaagttgaattggtcaaacttaggaaataaataaaaaataccgcacttttttaaaaagtgcggtatttttatccgtattttaattaatgtaaaacatcaacaatatttaaaaagatgtttaatgctacgctatttaacagatcgataaagaatgcaccaaccataggcacaattaaaaacgctttgtgggacggtccgaaatgagaagtaactgcttgcatattcgcaacggctgttggtgtcgcccccaagccgaaaccacaatgccctgcacttaatacaacggcatcataatcacgtcccatcatgcgataagtcacaaaaatagaataggtagccattaccacaacctgtgctaacagtacgactaaaattggtaatgctaatccagccaattcccaaagttttaaagacatcaatgcgatagctaaaaatagtgataaacccactgtacctaacacatcaattgcctcatccgctactttgaacttcacaacatgagcgagtgcattacgaattaccgtaccggtaaataaacaccaaacaaacgtcggtaattgaagtgcggttccttttgtaagcacatctaaatattgcccggcaatcagacacacggacatcatcgtaatggtttcaataattgaacgagtattgattttgcggcgatatacgggcttttcaaatacctcttctatatcgtccacattttcatcttccggtacttccgctttatgcaagcgtttcaataagaatctggctaccggtccaccgataatccccccaaaaaccaaaccgaatgtcgcacaagccattgccagttccaatgccccttgaatgccaaaacgattacttaaagtttctgcccaagcagctcctgtaccatgaccacccgttaatgtaacggagcctgcgattaacccgtaagcaggatctaaaccaacaagcatagaggttccgataccgactgtattttgtagaataattaaaccaagtgcggcgaataaaaagataacgagaggtttaccgcctttcgctagacgagcaaagttggcacttagaccaattgagctaaagaacactaacatcattgtagtctgtaatttagtatcaaaactaaaactcatatcccaaaagtgatgcacaatgcttaagataatagccacaataaagccaccaaccaccggctccggaatattgtattcgctcaagaaatgtacacgtttcactaaaaaatagcccagtaataaaaccaaacaggctaatgccactgtttcataagtaccaaaagtcatattaacccctttttttgattgttgttcctgtatatattattaaatcagatactaggataggaaaaattagcaaaatatttttgcaaattcagcaagcctgtggaacgtaacaaaaaaaagcatttttgtctagcaaattacttctttatgtatcagtaaaagtaaaatttggtagatctatttagtcaaattcaagctcaaccgcattttctcctaacattgttaccagtgcactcaataactcatctgttggataaacagaccattgcacaccgaagcgtatcaaagctcgtccgtctttactttgatagtaaagatgtattggcaaagaaccgccgctacaaggttcaataattcctttgagttggcgaataaagtgcggtgttatttgctcttgggataagctgatggctaaattttttgcataacgactacgagcttcatctaaagtcattaactctcgtacagacatttttagcccttgagaaaaatcatcaaaactgactgtaccggaaacaataacaacggtgtccttctgtaatttatcaccaaaacgttctaaagcatcagcaaacaacgttatatctaaaagcccggaacggtcatctaaagttgcaatacctaatcggtttccttttttcgtcactgcaaatcttaatgctacaattaaaccgcaaacagtacttattttgcctcgagtgtttggagataactcatttaaacgtgtcgaactgtaatgagacaactcttttaaataacgagtaatcggatgactgcttaaatacaaacctaatgtttcacgctcaccgtctaaaatttgtttctcgctccaacgtggcgtgtgtgcataagcggtttcaacatcttcatggcttgaagttagtacaccaaacatatcaacctgtcctatcgcctcatcttttgcatgctgatccgatgctttcaacgcatcttccaaattttgagcaagtgcggctcgatgtggacccaatttatcaaacgcaccggatttaattagattttcaaaggtgcgacgattaatctgttttaaatctactctcgcacaaagatcgaataaatctttaaaaattccgccttgttcacgggctgaaactattgcatttattgggacttctccaacgccttttatcgcaccaataccataaacaatttcaccattatcattcacactaaaatgatgtttgcctgtattaatatcagggggaacaatagtgagacccatacgtaaacactcatcataaaagctcacgatcttgtctgtgttatccatctctgaggtcatcaccgctgccataaattcagcgggataatgtgtttttaaccaaagggtttgataagaaaccaaagcataagcggcagaatgagatttattaaaaccataaccggcgaatttttccactaagtcaaagattttcatggctaaatcgccatcaatcccttttgctattgcacctttttcaaaaatatctcgttgtgccgccatttcttcaggttttttcttacccatcgctctacgcaataaatccgcaccgccaaggctgtatcccgccagtacttgtgcaatttgcatgacttgttcttgataaacaataaccccataggtaggttctaaaatcggcttaagggattcatgttgatacttaacatcaggataagaaacaggttccactccgtgtttacgatcgataaagttttgcaccattccagactctaaaggaccggggcggaataatgctacaagtgcaataatatcctcaaaacagtcgggctgaagtttcttgataagatctttcattcccctcgactccagctggaagactgctgtggtttcagcttttttcaacaagttaaatgaatcgggatcatttaaaggaattgtcgaaatatctatcgcacttttaccctctttaactaaacgagcgttaatcatatccaatgcccatttaataatggtcagcgtgcgtaagcctaaaaagtcaaatttcactaatcctgcatattcaacatcatttttatcaaaatgtgtaacaggatgtttcccttccgagtcgcaatatagaggtgagaaatctgtaattaaactaggagaaataactacaccgcccgcatgtttacccgcattacgtgttactccctccaattttcttgccatatcaattaaggctttcacttcttcatcattgttataaatttcggataatctcggttctacctcaaaagcctttgtcaaggtcatacccggatcggcgggaattaatttagcaatacgatccacaaaaccataagggtgtcccaatacacgccccacatcacgaataaccgcttttgccgccattgttccaaatgtgatgatttgcgaaaccgctccacgcccataagtttctgcaacatgctcaatcacacgatctcgcttgtccatacagaaatccacatcaaaatccggcatagaaacacgttcaggattgagaaaacgctcaaaaagcaaatcaaattcaagaggatccaaatcggtaatttttaacgcataggcgactaaagaacctgctccggaaccacgtcctggtcctacaggaatatcattatcttttgaccactgaataaactccatcacgatcaaaaaataaccgggaaagcccattttattaatgacatccagttcggtttgtaagcgatcatcgtattctttacgtttttctgaccgcacttgcggatcaggaaacagggtctgcaaacgctcctctaatccctctttcgatttttggattaaaaaatcttccggacttaagtcacccgttggaaatttcggtaaaaaataagtccctaagcgaatagtgacattacaacgttgtgctattaatacagtattttcaagtgcggtaggaatatcagcaaacagctcacacatttcttgctccgagcggaaatattgttgtgaactgtataatttcgggcgtttcggatcatccagtgtataaccatcatggatagccactcggatttcatgtgcctcaaaatcctccggacttaaaaaacacacatcatttgttgctactaaaggtaattgtttttgctgtgcaagtattaaagcagattgaatatagcgatcttcatcggatcgaccggtgcgacttaaacttaaataaaagtggtcgggaaaatattcttgataaaaagctaccgcagtttccacatcagcagaattatttttcagtaattttttccctacatcgccattgcgaccaccggataaaatgataattccctcatgatgttctgccaaccaagactgatcaatgtaaggtaaattataataaccacgttcataagccttcgaaagtaataaggtaatattatgataaccctcgttatttttggctaataacgtcagttcaaaaagttcatctcccaacaaatcacttttcacgagaacatcagcaccgataataggcttaacgcctgaagattgtgcttcaccataaaaacgaactaagccacaaaagttagtaaaatcagtcaatgccattgccaccatttcatgttgcacacaggcttttatcaaaggttttaccttagtaatgccgttaatcatggaaaaatcactgtgtacacgcaaatgtacaaaacgaggctgtgacataaaaaatcctataaaaataatttgagggaaaaagtgcggtgtattttagcgatatttctcaacaagctcaatcaaaggcaaagggcaaaaattccagcaaattattaccgcactttgaaaaaaagaaacccgactaaaagccgggtttaatttagctaaaatgaactactgttttgcaacaaccttcccatcaacataatccacaatgacttttttacccggtaataattgtccggataagatttgttgtgctaatggattttcaatttcttgttgaatggcacgttttaatggtcttgcaccgtaaatcacatcgtagccaacttcaccgataaaatctaaagtcgcatcggtaaattcaagctgataaccatgagtttccatacgtttcactaagcgttgtaattgaatagtggcaatggcacgaatattttctttagctaatggatggaataccacagtttcatcaatacggttgatgaattcaggtcggaaatgttgccctacaactgacataacaacctctttcatagcattataatccaactctttattgccttgaattaaatcagagcctaaatttgaagtcataatcactacagtattacgaaaatcaaccgttctgccctgtccatcggttaaacgtccatcatctagcacttgcaataaaatattaaagacatcgctatgggctttttccacttcatcaagcaaaatcacagaatacggacggcgacgaacggcttcggttaaataaccaccttcttcataaccaacatagcccggaggtgctcccactaagcgtgaaacactatgtttttccataaactcagacatatcaatacgcaccatggcattttcatcatcaaacataaagttagcaaaggttttacaaagttccgttttccctacgcccgttggtcctaagaacaagaatgagccaataggacgatttggatcagataatccggcacgactacgacgaatagcatttgcgacagcaacaaccgcctctgattgtcctacaacacgcttatgcaattcttgttccatacgcaataatttatctttttcgccctccatcatttttgcaacaggaatgcctgtcgcacgtgaaagcacttcagcgatttcctcatcggtaacacgatttcgcaataaagtcatctcttttccttccgcactttcagcttgtgcaagctgtttttccagctcaggaatacgaccatactgcagctcagacattttcgcaaaatcactgattcggcgagcttgctccatttgaattttggcattgtccagctctgccttgatgtgttgagcacccgaaagtgcggctttttccgccttccaaacgtcttccaactccgcatattcacgttctttttcaccaagctcttcctcaagaagatccaaacgcttgcgacttgcttcatcatcttctttttgtaacgcttgttgttccaattttaattgaataatacggcgttctaatctatctaaaggttgtggcttactatcaatttccatacgaatacttgaggctgcctcatcaattaaatcaatagctttatccggtaattgacgatcggaaatataacgatgagaaagggtcgctgccgcaacaattgccggatcggtaatttgcacatggtgatgaatttcataccgctcttttaacccacgtaaaatggcaatcgtatcttcaactgtcggctcaccaacaaataccttttggaaacggcgttcaagtgcggcatctttttcaatatattggcgatattcatctaaagttgttgcacctacacaatgcagttcaccacgagctaaacttggctttaacaaatttcccgcatccattgccccgtcagtttttcccgcacctaccatagtgtgaatttcatcaataaataaaatcacacgaccttcttcttgtgccaattctttgagaaccgcttttaaacgctcttcaaattcaccacgatatttggctcccgcaattaacgctcccatatccagagaaagaacacgttttccttttaagccttcaggtacttcaccgtttacgatacgttgtgccaatccttccacaatcgctgttttacctacacccggttccccaattaataccgggttattttttgtacgacgttgtaaaacctgaatggcacggcgaatttcttcatcacgcccgataacaggatccaattttccactttctgcccttgcagttaaatcaatagtatatttttctaatgcctgacgattttcttccgcaccttgttcattcactttttcgcctcctcgcaatttatcaatggcttgtagtaaatttttttgttttataccgcactttttcaaactttcacttaaagcacctttatcttcaaaaattgctaataaaaataattcagaggaaataaatttatcttgccgttgttgtgccagtttgtcgcataaatttaataatttgaccaaacttctggaaacctgaatatccccattattccccgaaacttgtggtaaacggctcaattctgtagttaattcattatgcaataatgctaaatttcccccacttgctgttaataatggcatgattgaaccatcttgctgatttaaaagtgcggtcattaaatgaaccggttcaataaattgatggtcttttcctatggctaaagattgagcttcagcaatagcttgttgaaatttagtcgtaaatttatctatgttcataatctctcctaaaattaatttctgcgtttcatcgtaaaaattaaccacataatgaaacgccttctattcgctcactagttaagtaagattaaacaaagatatttcaagtagaaaagtaaaataaatttagtaaaacctattaattaaatgaattttaataggttttacaataaatagagggcattaatgaaaaagttttttcccaaagaaaaacaacaataaacccaaaccgatgacgataaagccaataagttgccatacatttatcgatcgttgactcataccaattaaaccgaaatgatcaatgatcaaagcagtcagtaattgaccgacaataataaagaacagcatattggtgacgccgattttgggtgcaagaaagatagtggtaaataccgctaatgcacctaataaaccgccgatgagtttccataagggctgtttagggacttgttgtagtgctgaaaataaatccattttccaccagcaaatgaaaaataacgctatcgttcccatcgcaaaggaaacaaaggctgcaaagacaggttgtcccgagagagattgtgctaactgagtattaattgccgcttgtgctgctaatgcgatccctgcacataatgcaattaatataaatggaagtaacatttttattatcctttaaaaaattcagtgaaatgaattgcattctatacttttcaagcaaagatacaaaagctaaaatgtcgcaataatataaatcctataacatgtgctccaagttcaaactttttccataaaaaatgtatgatagacatgttattaaactaaatagcttttaagggaataattatgacaaacacaaacgtacaactcatacaagaaggcgtaaatctaatgctttccggtatgggctttgttttagtctttttattaattttaatttttgctataaaactgatgtctaaacttatcggttacttttcatctgaaccaacccttcctcagcaagcgtttattcctacaacagaattaaatgatttagagcgtttacgtccggttattgtagcagcaatagcacatcaccgtcgtcaacaaaatttataataacggagaatataaatggctactcacgagaaaaaaatttctataactgacgtggttttacgtgatgcacaccaatccctttttgctacacgtttacgccttgatgatatgctacctattgccgccgaactggataaaatcggctactggtcgcttgaagcttggggcggtgcaacctttgatgcttgtattcgctttttaggggaagatccttgggttcgtttgcgtgagttgaaaaaagctattccgaacacgcctttgcaaatgttattacgtgggcaaaatttattgggctatcgtcattatgctgatgatgttgtaaataaatttgttgaacgtgctgttgcaaatgggatgagcgtatttcgtgtattcgatgccatgaatgatccaagaaatatgcaacaagcgttaagagcggtgcgtaaaaatggcggacatgcacaaggtacattgagttatacaacaagtccggtgcatacgttagaaacgtggttagataccacagagcaattgttagaaatcgggatcgactcgctggtcattaaggatatgtccggaattttatctcctgtcgaggcatacaaattagtcagcgaaatcaaaaaacgctacgatgtgcgtttacatatgcactgtcattcaacgacaggtatggcggaaatggcattactcaaagccatagaagcaggtgcggatggcattgacacagcaatttcctctatgagcggtacttacggacatccggcaacagaggcattagtagctacattagataacacacagtacgataccggattaagtattccacaacttgagcgtattgctgattatttccgtaatgtacgcaaaaaatacgctaaatttgaagggcaattgagaggcgtggatagccgtattttagttgctcaagtaccgggaggaatgctgactaatttagaaaatcaactcaaacaacaaaatgcttcagataaactggataaagttttgcaggaaattccaaaagtgcgggctgatttagggtatattccactagttacaccaacctcacaaattgtcggtactcaggcggtaattaatgtattaatgggtgaacgttataaaactattgcaaaagaaaccgcaggtattttaaaaggcgaatatggccgtaccccggcaccggtgaatgcagaattacaagcaaaagtcttagcgggtgaacaacctattactgatcgtccggcagatcatctagccccggaaatggataaactatccacggaaataaaacggttggtaaaagaaaaaggtattcaacttgcagagaatgaaattgatgatgtattaattgttgcacttttccctcaagttggattgaaattcttagaaaatcgaggtaatccgaatgcttttgagccggtaccaaccaacgaagtaaaaacaagtgaaaaaccgaccgcactttcaagtagaaatgatagtgccgtttacacggttgaggtagagggaaaatcttttgtagtgaaagttactgaaggcggtgatattagtcatattacacctgtctcgaccgcacctagtacacaatcaacggaaccggcaacaagtgcaactacaaaaaatataccggtaaatgcacctatggctggaaatatctggaaagtactggtaaaagaaggacaacaagttgcggaaggagaagtcttgctcattttagaagcaatgaaaatggaaacagaaattcgagccgctacctcaggaactgtacagggtataaaagtgaaagcgggtgatactgtggctgtgggtgataccttattaactttagcgtaatcggagattaatatggaaagtattctcgccctattacaaggaacaggcattatgcatttaagttgggggcaggcaattatgcttgtcatcagcttgctcttactctaccttgcagttgtgaaaaaatttgaaccgctcttattgctaccgattggatttgggggactcttatccaatattcctgaagcgaatatggcgttttcggcactggaaaatttacttcatagcaataacaaccaacatttatctacgcttgcaaatttactgcatagcgataccgacgtacaggcaataaaacaggtactggaaaaagcaccggcgttgttacatgtgcaagcagaattattagcgaaagatttaggctataccgatggtgtgttgtccactttttatgatgtcgccattaattcaggtgccgcaccattgattatctttatgggggttggtgcaatgacggattttggtccattgcttgctaatccaaaaaccttattactgggtgcggctgcacaattcggaatttttgccactgtgctaggggcgttagcattaaacgggttagggatcattgaatttaccttgcctcaagcagcggcaatagggattattggtggtgctgatggtccaaccgctatttatctggcaagtaaacttgcccctgaattattgggggctatcgccgttgccgcttattcctatatggcattagtcccacttatccaaccgccaataatgcgtcttttaaccactaaacaagagcgtaaaattaaaatggtgcaactgcgtaatgtcagtactcgggaaaaaatcttgttcccgatcgtgttattggtgcttgttgctttattattgccggatgccgcaccgttattaggaatgttttgctttggtaatttaatgagagtaagtggggtagttgagcgtttaagtgatactgcacaaaatgccttaatcaatattgtaacaattttcctcggattatccgttggtgcaaaattagttgcagataaattcctacaaccgcaaacgttaggtatcttattgctcggcataatcgctttcgccatagggacagcgagtggcgtcctaatggcaaaattgatgaactgctttagtaaagataaaatcaatccgcttatcggttcggcaggtgtttccgccgtgccaatggcggctcgagtatcgaataaattaggcttagaggctgatcatcagaactttttattaatgcacgcaatgggaccaaacgttgccggcgtgatcggatccgccattgcagcaggcgtgatgttaaaatatattgcagcaatgatgtaaaaatcattcccttaagattgaaaataaaaataaggacgaaaattttcgtccttattcatttttaatacaatgttagaatttctctagtaacattttttccaatttttcttggtcaatagcaaacttacggataccgtcagctaatttctcaactgccattggatcgctattgtgttgccaataaaattggctttcggttaacggttgaggttttgctttaacttcacctttaaacgctaatttacgcacaagtgcggtgctattttcttgtaattcttttaataatgccggtgcaatagtcaaacgatcgcaacctgccaattcagtaatttcacctacattacggaaacttgctcccataacaacagtgttataaccgtattgtttatagtaattgtaaatttttgtaacagaaatgacgcccggatcttccgccggtgcatattctttcttatcactgtttgctttataccagtcaagaatacgtcctacaaaaggtgaaattaaataaacacctgcttcagcacaagctcgagcctgtgcttcagagaacaatagcgttaaattacaattaatcccttctttttcaagaatttctgcagcacgaataccttgccatgtagaagcaattttgatcaaaatacgatcgttgccaatacctgcttcgttataaagtgcgataagtttacgtgctttttctaccgttgcttgtgtatcataagaaagacgggcatctacttcagtagaaatacgtcccggaacaatttttaaaatttctaaaccgatatttactgccagtttgtcttctgcatcaattagttgctgtgttttatccgcactttttgctttcgcataagcaatcgcttcatcaattaatggagcatattgcggtaatgatgatgcacttaaaattaaagagggatttgtggttgcatcttgcggttgatattttttaatcgcatcaatatctcccgtatcggcaactaccacggtcatattacgcaaagcgtctaattgtgttgtcatagtctttccttttatttagctataaagaattgaactcgcatacaataccatatctttgaaattatgaaatcattattttacttttaagcgtacagaataagtatattcttcaccttatttataatgctttttagcacaattttatttataatcgagggcaatttttggcaaacaaaatagctcaacaatgaaaaaaaattattacactgtactttctctgtcaattttgaccgcactttatagcacgtccagtcaagcgaacttacaacagcaatgtttgatcggtgttcctcattttcaaggtgaaatcgttcaaggcgatcccaatgaattgccggtttatattgaagcggatcacgccaaaatgaatcaatcgacacatgctcaatacgaaggaaatgttaatgttaaacagggcaaccgtcatttaacagcgggaatgattgaaattgagcaacacggaaaagataatgcgaaacgttatgcgtatgctaaaaatgggtttgactacaaagataatttaattcagctcaatggtgataatgctaaaattcaccttgatagcaaagatgccaatatccaagatgcagattatcaattggttggacgacaagggcggggaactgctgatgaagttgaacttcgtgaacattatcgagtgatgaaaaatgcaaccttcacatcttgtttgcctaatagcgacgcttggtcaattgaggctaaggaaatgcgtcaacatattcaagaagaatatgcggaaatgtggcatgctcgttttaaagtatccggtatccctattttctacacgccttacctacaattacctatcggtgatcgccgtcgatccggattacttattcccaaagcaggtatctcaactcggcatggttattggtatgcacaaccgttttattggaatatggcaccaaactttgatgcgacatttacccctaaatatatgtctcatcgaggttggcaattaaatgcagaaactcgctatctgactcgtatcggtgagggaaaatttgtcgttgaatacttaaaaacagatcgtcattctgactctttaaatacggctcgttcacgtcatctcttttattggggacataattctcattttctaaaagattggcgtttaaatgtaaattatacaaaagtaagcgataaacattatttcaatgattttgagtctgaatatggaaacagtacagacggatatgtagatcaacaggcgagcatttcttactatcaaccgaattacaacctttctatttcagcgaaacaattccaaattttcgataaagtagatattggaccttatcgtgcgttgccacaaattgattttaattattatcgcaacgaaattgctaatggcttagttgactttagtttattttcacaagtagttcgttttgataatgacagtgcgttaatgccaactgcttggcgtttccatatagaaccgagtttgacttttccactttccaatcgttacggcagtttaaatattgaaactaaactttacgcaacacgctatctacaaaaacgaggtaaaggagaaaatgcagaagagattaaaaaaacggttaatcgtgttttaccacaaatcaagctggattttcaaacggtcttagcaaatagacaaagtttcattgaaggttatacccaaactcttgagccaagatttcaatatttgtaccgcccttataaagatcagtcggatattggtctaaaacaacaaaataatgattacttaggtttcggttacgactcaactttattacaacaggattatttttctttgtttcgagatcgccgttatagcggtttagatcgcatagtttcagcaaatcaaattactcttggtggaacgaccagattttatgataaaaatgcaaatgaacgctttaacttatctattggacaaatttattaccttaaagactctcgcacagataataatccaaaaaatacggctcaaggcagatcttcttcctggtctttagaaagtaactggcgtatcaatagcaaatggaattggcgtggaagttatcaatatgacacacatttaaaccaaacatctttggcaaataccgtcttagaatacaatccggagaaaaacaacttaatccagctcagttatcgctatgttaaccaatcttatatcaatcaaaatttgaaaggtagaaatacttatcagcaaagtataaaacaacttggtatgacaacagcttgggagctaactgatcattggacactggttggtcgctattatcaagatctcgcattgaaaaagccggttgaacaatatttgggaatacaatataactcttgttgctggtctataggtgttggagcaagacgttatgtaaccaatagagcaaatcaacgcaatgatgaagtgctttatgataatagcttaagcctcacttttgagttacgtggattatctccttcggatcataaaaataatatagatgaaatgctgaaaaaaggaaaactgccttatattaaagcctttagtctatactaacgttcaaatttaacgaaacacaccaaaaaacaaaccgcacattaagtgcggttttcttttagattatgttgaaaaattacagtacatcaacacagttcaaatcttcgaaagatttttctaaccgtttagacatagattcttctgctttgcgtaaccaaactcgaggatcatagtattttttattcggtgcatcaggtccttccggattacctaattgaccttgtaaataagcttcatttgctttatagaagtttaaaacgccttcccaagttgcccattgagtatccgtgtcaatattcattttaattgcaccgtagctgatcgcttcacgaatttcttccgttgaagaacctgaaccgccatggaatacgaagtctaatgatttcgccggaagattacgttctttagaaacaaattcttgtgatgcacctaaaatagacggttttaattttacgttgcccggtttatataccccgtgaacattaccaaatgctgctgcgatagtaaaacgtggactgattggacttaattgatcgtaaacaaaaaggacatcttccggctgagtataaagtttagattcatcaacatctgagttatctacaccatcttcttcaccgccggtaataccgatttcgatttccaatgtcatccccattttatccatgcgggcaaggtattcacgacaaattgccatattctctgccattggctcttcggataaatcaatcatgtgagatgagaacaatggtttgcctgtttcagcaaagtgtttctcgcctgcttccaataaaccgtcaatccaaggaagtaatttttttgccgcatggtcggtatgaagaataaccggaacaccatattctgccgctaatgtatgaacatgtttagcagccgcaattgcacctaatacatccggacgaataccgctagccggtttaattccttttcctgcataaaacgccgcaccgccgtttgagaattgaataataacaggtgcttttactcgtgcagcggtttctaatactgcattcacagaatctgtcccaacacagtttactgccggaattgcaaagttatttgcttttgcgtaagcaaatactttttgaacgtcgttaccggttaatacaccaggttttacaatgtctagtaattttgccatttttatatttcctatataacgtgcaattcttgcactactaaaaattaaatcaatctacaacgtaaagtataatgcttttcactttacaaaattaaccatttgctcgtttttctaaaatttcaaccgctggtaatactttgccctctacaaactctaagaatgcaccgccaccggtcgaaatataagaaattttatctttgataccgaataaatcaatcgccgccaaagtatcaccaccaccggcaatagagaaagcaccatttgcggttgcttcagcaatcgcattagaaacgatttcagtacctttacgaaagttagggaattcaaagacccccacaggaccattccaaagaatagtttttgcattgcggataatatcagccaattgctctgctgatttatcaccaatatcaaaaatggattcttctccggaaacgtcggctacacttttttctgttgatagtgcggtttctgaaaattcagtgcccacacgcacatcaactggaacaggaatattcgttacttttgataaacgttgtgcttcaggaattaaatccgcttcatataaggatttacccacattatgcccctctgcagcaatgaaagtattcgcaataccgccaccaacaatcagttggtcagcaatttttgataagctgtccaagacagttaatttagtggatacttttgaacctcccacaatcgctaacattggacgctgaggctcttttaatgctttacctaacgcctctaattccgccgctaataatggaccggcacaagcaacaggggcaaactctgctacaccgtaagttgaggcttgtgcacggtgagccgtaccgaaagcatccataacaaatacatcacaaagtgcggcatattttttacttaattccggatcatttttcttctcacctttattcacacgtacgttttcaagaacaacaatttcaccttcattgacttctacaccgtttagataatcttgcgctaaacgaacattaaaaccggcacctttcaaataatcaacaacaggctgtaatgaatcttcaggtttaaattccccctctgtcggacgacctaaatgagaagttaccatcactttagcacctttctcaagtgcaagttttaacgtaggaatagttgctttgatacgtgcatcggaagtgactttcccctcttttaccggcacatttaaatctgcacgaataaatactctcttacctgctaaatctaggtcggtcattttaattactgacataattcaccccttatattggttaaaattgataaaaactaccgcacattatacctagttatgaacaggttgtaacgaactagatcaaattggctttaatatcttgttgcataaattaaatcattaacaaaaaactcacgtttctattaataataattcaatctagaataactgaaatccctattcagttttcaacggatattctttataatcagccctttttacaacagagttaaaggacatggcgttactcatcactgataaatgtacaaattgcgatatgtgtttaccggaatgccctaatgatgccatttcaattggtgatgaaatttacattatcgatcctcatctttgtacggaatgtgtgggacattatgatacgcctacctgtcaaaacgtctgccccattaccaactgcattaaaaccgatccggaacatattgaaacggaagaacaactttgggaacgttttgttttaattcatcatgcagacaaaatataaaaaaaagggcgtataaacgcccttttttgatggatgaaaagtcaagaattaccagctataaccgatacctgcacccacagaagttttcttatcgccatgtcctaagctgaacttaacgctaagtttaccgttatcggacactctggaataacctaccgcaaaggcttgactccccatatagttaccggtcgccaaacttaacgtacttttacccggtaatatattgatcggtaagttcgcttgtgcaacagcttgagccacacccgcgcgcatattgcgatcattattgttcatttgtgtacgtaactcgtgatttctcgcatcgacatagtttttgttcactgccatatcaccatctgcattaggtttaatattcggcacggtgataatacctttttcaccatcaatcttaatctcaccgcctgcaccgtttacggtcaatccgtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatcttccaacaccaccgcttccgctccataagttgcagatttggctttatcatcagtgccatctttgcctttattgaccactctcaagccgttgctgtctaaagtagattttctaccctccacttcacgtgtctcaaaagaggtcatatttttcaactgatcggacaatttaacttctaagcctttgccgtcttgtgccatttccactttgatattgccggtagcagtgcggttgctgttaaatgttccctcgcctgtgatagacagggtttcacnnnnnnnnnnnnnnnnnnnnnnnnnnnnnnnnnnnnnnnnnnnnnnnnnnnnnnnngccacggcttgtaaatcgccaacggtagcgacattgcttaaattagcttggctatccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctttgccatggacagttaaaccgtctttgccataaacggtatgggttttgtcgtcattggttgcgtctttatcacccacggttaaaccgtctttgatcaaggttgctttgccatctttgctttgtggcgtgagtgaaataccatctttatcaattttcactttagaaccttgattgccaacttggaaagtagcaccattatttggatctaaagtaagtttagtgacttcatcttgatttccaaccgcacttgaacctgcaccgcttccgcccgcacttccatttttaggtttagaagaaattgattttatatttttcaaatcctcagtcgtgccaatggttaccacagccgttgttgttggggtagtggtggttggcgtggtagttggtgtacttgttggcgttgtcgtagccatgcctgcaccatttgaaccacctgacgaagccatactatttgaaccaccgccgtttgtacttgcactacctgacgaaccgcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaatattctgatcactcgtaaayttcaacgtatcgccacgaccgatttcrayagtytkaccryyaccattttcaaccttgaacttaaacttatctaacgcttgttcaaggtagcctttggtgatgagttcatttttccaatctgtacttccactatttcctcttccgccatcatatgtttgctctttagaaagcgttactttgctaaatatcggtgcatttttaaagccgatttcgattttggcgttgccgttagtttctctcgtgtattgagtgattaaattatcacctttaaactcagcaatatttggttgtgatgaagtccccgccggagctggtgtggatgacgcccctgccgtatttgaagccaaacgaacaatgctaagggtcgaaccaagatagtgcggtgtgttttgagtgccatttgttcccgcacttggcatatccgcactgaatttcaagccttcgttgagtttcgttacagcatttttcaatccttcaacgatattttttggtgcagnnnnnnnnnnnnnnnnnnnnnnnnnnnnnnnnnnnnnntcaaagattggagcagtaaatttcgttttatctgaagtactaacatcaacgcctaattgcttagtcaaatcagcgagttgtttacctgttacggcttcttttgaactctcagcaatttcaccgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagattattattaagcgtatgcgtaatttttccatccgcttccacagcaacagaaatattttccgacttcacgaagtctaacgcccctgttttgaggttgatagattgcttcgttttgtcatcactattcgctttatacgataaggtcaagccatcaacatatttcttattgacggcatcgtattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataaccaatagcaattgccccttcattttttgctactgctttatcgccaatcgcaatagaacmgncyccttcagccttagtttccggattatcggatactttaacggatttttgacctgtaccttttagatacttaataaccgcatccgcctgtactaattcagttgaacttttctcagtttcgccgagtttaatggtatcaataccaacattttgtcctaaagnnnnnnnnnnnnnnnnnnnnnnnnnnnnnnnaacttttaagaagtctgtttctaattttgccgttggggtgtactctttcaaytywkywgcwactgctttagaagtcacgactttttcatcagtttcagaaaccgtggttgctttatttaaagtcagcgtaagtgtacctgcgtttttaacatcttgcccattagatggtgctaatgatacggtgatgtctttttgtgtcgcatctgttgcaccatcggcttttaccttgcttgtcgagctgtcaatggtcaatgttccgccnnnnnnnnnnnnnnnnnnnnnnnnnnnnnnnnnnnnnnnnnnnnnnnnnnnnntcaatccaccattaactgcggtgattaactgattaatagcctctttaaaagttgtaggacctgtattgctattagttgtaccaccagttgaacttgtaccgcctttaattgctgcaaaggttggtgctttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacatttgagattttcacggcatttccgctatcggatttagtaaaggtcaacgcatttccgccaacttttaattccgcggtgtttccggtgccacttgtactgtttttaaacactaaggtgttactatcatctttaccgatggtagataagccgctggcttgcactccgccatttgtcgtgtcttttttcaacgtaacagttgagccgttttccggacttaactcgattttcttgtccccattattgacgactttaatacttccggcatctttacccgcacttaacgttgcactagtgccatctaaagtaacgcttgaaccgtctttggcactttctaaagtcgccgttttgtctttcaattcaagttttgamttgtctttsgyrctttctaargtsgcastgttytcagtgagtttyaacgctccyttrtccgcttctttattaatttcagaaacaccgctaaatttaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttccttggaatgacagccctttatttttcaattcattagcgatatgaagcaaatcgcctgcattgatggctttgtttaatttgccatcatttgatgttccaccattttgcggttgtcctgtggcaacaagttttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttgtttaaaagacggtttatcttttatgccaattaaaagctcttttgtattttgttgatatgatgttttaatattatcgctactaaatccatcatcactggttgattttttatcgatattccccgctttaatctgcaaggtatcgcccagttgaagcgtgccagttgcagtaccgtcgccaatgacaagccctttattcacagccacgatcaaatcatcgattgcttctttaaaggtggtttttccgttagtttctgtttgcccttgataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaaattagcggcgacattagctaatttcccgtccacataggttttcgtggttaatgtcttcccatcactactatcatcgactgttccactcactttgacttctttaaaggtcggtttgtctttgataccgattaacagctctttgctttttgctagatacgctgttttaatattattcggcgaatagccatcttctgaagtgctcgtcggtttatcgattgctcccgctttgatgattaatttatcgcctaagtaatgcgttccttgttcattattagaatctccaacaccaaaaataaatcctttattaatagctgttgtattttgaccaatggcatctttaaaggtcatttcttttgatgtttgagtatttgtattcccattatatttaacaacatcaaaacttgattttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttctttaaaggtcggtttatctttgataccgattaacagctctttgctggttgattgatagcttgtcttaatattatcactgctatatccatctacatcagatgttggtttatcgatattccccgctttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaaaatatcacccacatttttaagctgattccccgtaatcgcctgatcggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttagccccaactaatactttttcttttggaatttcttgtttatctaatggtgttccatattttgtatctaccttgtagaagttgccatctgttcctttaactaatttatatatttttccattatcttgcgtataataaacgactaagccttctctttttacatattctaaggcttttaattgcccaatcgtcgccacgtcagagtccaacgcacccggtgctaccccgacaatccgtcttaagcccagttcttgacttccactgttaccctttgtccaacctaccgacacaatacccgctgttttatcggttgttaagttatagctagaaccctctggaacataagggnctaamtcaatcgcctcntntccggttgaggtggctgtgtttttgttaccatttcgatagaaatatttcgtatgtgatttatarccyantgctaccgagttttccatcgtagactgtgcttcattacctaaagcgattgaacttactttagtagcctttgaatttgtcccaaaagcaattgcattttcagaatttgcttcaacttttgcgttatctcctaaagctatacctttttcagaataaacatatgattctgtacctatagaaatagctgacatttctaattctactttttcagcctcaagtccaaattttcctttctttaaatttgctatttttacatttttattttgactttgattttcaacttttgcactatttcctattactatwgattttyytgcatkwtctttcaaacttgcatcatttcctaaaactatactttctcctgataaaccgtgagaaccatatcctattgatattgtattgtcttttgttacacctaccccagaaccaatggcaattgctcccgctcctgttacattaactcctgttccaattgcaacagagttttctttaaatacatttgtaccaatcccaagtgctattgtatttgttgcatatttccctatattatttaatgctcccaaaactaccgagtttgatcctcttactatagatgcactacctatagtaatagtattatccccattatttgaaagatgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgttaatgcaccttggttagaggcttctgcctcatttcctatagcaaatgaattmgswgcaaanaccctagattcgtcncctattgcwaccccaccntctgcatykktwtcaacraatgcacgracaccaacagctgtwgagyttttwscnaaagcaaatgataakgtwcckawtgmaagtgaagnatctccaaakgcaacagatcttgacccaatagctattgatcccactcctgctgcgtatgtcggtgaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatcatcattccctattgcaatagaagcataaccagcagccattacgtccgatcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttcaccccatttttcttgtacacctgctgctcctgtccttccgtccatatcaatatatgttatgtcagcatatgaaacactgctcacaccaagcatccccgacatcaacaacaccaacggtgaaaatttaaaaatgcctaaaaaattacccaaaaacacaccgcactttgatttactcttcgaactgctcgctatttggcggttgcttgccaactcggaaacagctttacattgacctgttgtaatatcgtatttggttttaaatattttgttcataaattcactcgctttaatcttttaaaattaggttttttattgatttattttgttgatttttttaacttttttatagttattaatggattaaaatttttgctttttagatagattaatgaggtataaatcggcgatgccttgctttttaagacacaacaaaaaaaggcgaataatactttcgccgaaaggttgaggttgaaataggtgatttttaagatattgtttgaacatgtccaacctctcaaaattaacttgaaaggttgattttagccaatayactaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctcattttattcctgtgatatgtaatgtacaaataatatatcgggccgattattctaacctaaatattatgaaaaacaaaaggattttttagttaaatctgatttgatgtaagaaggctttagtgcgttcatgttgtgggttttcaaataacgtttttggcgatccttgttccacaataatgcctttatccataacgaccactacatctgccacatctaaagcaaatttgatttcatgcgtgactacgaccattgtccaaccttcgttagcaagctctttcattgtgtttaatacatcttgaactaattcaggatccagtgctgaggtaggttcatcaaacagcattaattcaggtcgaatagctaaagctcgtgcaataccaactcgctgttgttgtccgccggaaagttggtgtggatagagattagctttgtctatcagccctactttacataataatgtttccgcttcttggcgtacttcatcaggattgcgttgttgtacttgaacaggtccttccatgatattttctaatgcggttttatgtggaaataaattatattgttggaataccatgcctgattttttgcgtagcggtaaaatgtttttgcgaatgtgtttgtccgtaaaatcaatatatagcggattttctttgtgaaattcgattgtgccttgttccggtaattcaagggcatttaaacaacgtaaaaaagtcgttttacctgaacctgatggtcctaagatgacaacaacttgacctttttctatatctaaatcaattccacgtaatacaggattattgtcaaatgttttatgaatattacgaattttaatcatcatttatcctttgttagcgagtaacataacgagcaagttttttttctatgcgagcttgccataagaacaagataaaacagaaacaccaataaatcagggctgcctcaatataaacgggtaagaaatcgtaagacatatttgctacttgttgtgccactcggaacatttccgttactgttactaccgaagctaatgaagtgtctttgaataaactgataaatgtattactcagaggcggaacggcaacacgaaatgcttgcggtacaataattcggcggaaagtttgcatataagtcatgccgattgtgtaaccggcttcccattgtcctttggggacggattgtatcgccgctcgtaccgtttcagaagcataagcaccgacatttaatgagaaaccgataattgcggcaggaataggatcaataaaaatccccagtgcaggtaatccataaaaaacgatggatatttgcactagcattggtgtcccacgaataattgaaatataaatttttgttataaataaaaagaggcgatggataatgctatggctcggactcactcgaattaacgcaacagcaatcgcaataaccattcccaatataaatgatacgatagcaagcggtattgaaactaataccgccgctttgaccatgggaaaaaatccattgatgactaattctgctcttgcctcagtcataaaaggcaatgaggcaaggaaattatttaacactgatatctctaccaaagaattgttcacctaattgttttaatgtgccatcgttgcgtaattcttcgatagcggcactgatttttgctagtgcttcatcattatttttattgacaataagccccgcacccactttatctttagattcccataccggttttaaacctgaatttgggtattttttcaaataatccaataaggctagtgcatcgttaaacgtcatatctgctcgtttttgttgtatgagtaataagccttgtgccatgccgtcaataggaacaatcttagcttggtatttttgtgccaattcaccatagtttgagctaagtgtttgtgctgcttttaagccttttacatcttcaacttgtttaatgcgagtttcattatctcgtgctactaacattgctccggaccaactataaggttcagatttgtcaaaagtggcttgacgttcaggtgttgttaatgcgacttggtttgctaccaaatcaaaacgtccagcttttaaaccagcaagcatcgcgtcccattgtgtttctttaaattcaacggttacacctaattttttagctactgcacgagtcacttcaacatcatatcctgtcaattttccggttgagtcgtggtaagtgaacggtgcgtaagtgccttccgtaccgaccgtaatcgttcctttgttgttaatgcgatctaataaactcgcctgtgctaaggcttgtgtgttggcgactattgcaaaaacggtagtgaataaaaatgttatttttttcaacataaaagctcctttcagtaaaaattgcgttgcggtaaaaaagagtgcttggcattgtaaaagaaatgttaaatattacaaataactttcgggaatatgttatgcagaatgggtgtttttatggagcgatgaaaaatgatcagaatttaacgcccaaagctcaagctgaaaaattaggaagcgagtaaaggaaaatcaagcgatatttcgttatggcacttgaaataatactgaataatagctatattacgacaaagggcgtaagctgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatgagctttgataagtgaattaggacttaaaaaagctcattttgttatatcgaaaaggtcaatgtagccagaataaataggcaaatgtgccgataaacagtacgcaaataatatttaagacaacacctgcacgaaccatttctttttgtttaatttcgcctgtaccaaagacaattgcattcggcggagttgcaaccggtaacatgaaggcacaagaggcacctaaaccaatgatcaatgctaaacctaattcaggcatgccaagtgaccgtgcaatagaaatgaagataggaactaataacgccgcacttgcactgtttgaggtaaattcagttaagaaaatgataaaggcggcaactaataaaccgataagatagaagttcccaccttcgatcatgaagactatgccgtcagccaaaactttgctcgcacctgagtcttgtaataccgcacttaatgttaaaccaccaccgaaaagcattaatacgccccaatccgtattatcttgtaactgtttccaagaaattacgccactgacgcaaacggcaatagcggcaagtaatgcgatgacactgtcaaaactggcaatatttttttccaaccctaataaagatgacagcattgggttgagtttggcactaaatatccagcaaaatgcaatagttacgaaaatgagtaatgtaatgatccgttgattattcatctcaactttctcaaagttttgtttgaaactcgccttgagattcggtttaaagataatgtaaagagtaccgatcatgattggcataagaataagcatgataggtaaaccgaaatagagccaatcggagaaagataatttcaattgagaagcaacaattgcgttgggcggactaccaatgacagttcccataccgccgatactcgcactgtaggcaatacctaataagacgaatacataagtgttatgttctttcgttctatctaattggctaagaatacccatagctaacggcaacatcatcgaagctgttgccgtattactcatccacatagacagaaatgcggtaattgagaaaagataaatgacgccaataaagagatttccttttgccagcatcattattttattggcgatcattctatccaatttttgaatatgcagtgcggtagcgagggcaaatcctccaaagaaaaggaaaatagttggtgctgaataagaagctaaagcggtttttgttgtgactaaacctaatgcaattgctataaacggcactaataaggctgttactgttacatgcagtgcttcagttagccataacacagcaataaagactaataaagccagtcctttatttgctttttcatcaaagggtaaaacataaagtagaacaaaaaaaacgataacatcaagaatgaatattaacgcattttggttaaaaattgatttagaaactgttttgctcataaggttatcctgcttagataaaatattgaactatccctatttgggggtaggaatttgagtgaaagttaccaaatggtaaaaaaaatgcaacgaccttttgttttttttgtgaggtatgtctaaaaaataaaaagtgcggtcttttgaaccgcactttttgtaggaattaatgctgaatggtgattataagctatcaaactcttctaaatctaaaggctcttgagaaagaataatgccggtaagatctgcataaacatagtcatcaggaaagaaggttacgccaccaaaatttaccggaacgtccgtttctcctatgctttgttcatctgaaccgacagggataggtgcaagtgcttgaataccgatatttatgttttctaattgttgtaattgacgaattgctccgtatacgataatcccttcccagccgttatctgccgctaattgtgctaagtttgcatcaattaatgcacggcgaaccgcaccgccaccatcaattaatagcactcgaccttcgccattttcttcgagaatttcactgattaatccattgttttcaaagcatttgattgtggtgattttcccaaagaacgtgcttttgccgccaaaactggaaaaaataggctcaacaacatcaatttgatcgaggtaaatatcacaaagttcagcagtatcaatatacatagggttttccttctatatttcggacagttgttaagtataaccaatattagtttacaagcaagctcaaactgaataatagattcgtgaacaaggcaagtaaggacatttgtgcaagcattgggcgtaaatataacggatttttattgcgatacacaaaatgtgcatgcttgatcagcagtggaaaagaaagaataaagataaaatttgaccaatgtgtaaatgtgtataaggcaaaaataatataacttaatgcactgagcaatagaataatgcaatgataaatacgtgcattctcagcccctagacgtactacaagggtatttttacctgcttttctatcttgttcaatatcacgcaaattattgatatttaataccgcagtagctaataagcctgttgcggtagcagggagaaaaataagccaatttagctgatgggtttgcagataataagtaccgccaacaccgagcagaccgaaaaatataagtaccgaaacatcgcctaaacctaaataaccataaggttttgtacctacggtataagtaattgcggcaagaatggcgagtaaacccaaaagtgcaaaggcaacaagatcaacaattgtttgataagcattcacaatcagtaaactaccggaaatcaaactcaagaatacaacaagaataagtccttgttttaattgttttgcgttaatagcaccttgttgaatagcacgcaacggtccgatacgttcttgtgtatcggaacctttttgatgatcgccataatcattggcaaagttggataaaatttgcaatagcaaggtcgttaataaacaaagtaaagttgttgtccaactgaactgttgtgaccaataagccaatgctgagccagtcataattgaggcggcagccaaaggtaaagttttgggtctagctgtttcaaaccacattttgacactattatttgccataatatccacattataattgatacagaaaatgaaattttcaccaagcgtgtaaatttgcgttattttactgttttattaatgaatttttaactgttttaaggaaaatatgtctaaatttttacttcatcttacgccgattgcaatcattcatacgccgtataaagaaaaattttccgtccctcggcaagcgaatttagttcaagacgggacaggtattgtggagttgcttccgccgtttaattgtccggaggctgtacgtggactggagcagttttctcatttgtggttaatttttcaatttgacaacgtgccgacaggtaaatggcaacctacagtacgacctccccgtttaggaggtaataagcgtatcggtgtttttgcttccagatcgacacatcgccctaatcctttggggttatctaaagtggaacttcgtgaagttgaatataaaaacggaaagattttgttacatctcggttcagtcgatttgattgacggtacaccaattttagatattaaaccttatattgcgtatgcggataatgaaccctgtgcaagatcgggatttgcccaagaaaagcccgagcaggaattgcgagtggaatttagtcctgaggtgcaaatagtattagcaaaattagagaaaaaacgaccgcacttaaagcgttttattcgagaggttattcagcaagatcctcgacctgcctatcagaaaggaaaaaatttgcataaaatttatggtatggcactgtatgaatttaatgttcgttggagaattaaacatgatgatgttacagtggcggaagtgattcacattcagcatgtttgatcttcaaataaattttttgatccacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcataaaatttatggtatggcactgtatgaatttaatgttcgttggagaattaaacatgatgatgatgttacagtggcggaagtgattcacattcagcatgtttgatcttcaaataaattttttgatccacttcacatttttacagttttcttttttctttttatgaaattttccattaaactactttttgtttaatcgaaacgtttcgatgataattatcaatgtttcctctgaataatttcagaaaaactggagaaaattaatatgaagaaaacaaaattattaaatgcgagcttatcacattatattgcaacgttaggccatacagacagtttggttatttgtgatgccggattgcctatttcaaatcaagttgaacgtattgatttagcgttggaggcaggcgttcccgcctttttacaaactgttgatgtggttataagtgagatgtttgtggagcatgccgttgtggcgaaagaaattagagaaaaaaatccgcaaattcatgacgcacttttagattcgttaagaaaattatcagaacaacaaggcaactgcattgccgttgaatatgtagaacatgaagaatttaaagtattaagttctgagagtaaagctgctgtacgtacaggggaattctcgccgtatgctaatattattttgtattcaggtgtgccattttaaccagttgaagagaggtatttatgcaagtggaaaccttgctcaaaattaccggtgtagataaatcttttccgggtgttaaagcacttagtaatgcttgtttatctgtttatgcgggacgagcaatggcacttatgggagaaaatggtgcaggtaaatcaacgttaatgaaggttttaaccggaatttatagcaaagatagcggttctattgaatatttaggagatgttgtcaattttaaaggacctaaggattctgaaacggcaggaattagtattattcaccaagaactgaatttagttgcaaatttaaccgttgctgaaaatatttttttggggtgtgaatttacaacctcttggggagcaattgattggaagaaaatgtacagagaggctgataaattattagcacatttgggtgtgtcatttcgcagtgatcagctttgttcggaattgtctattggtgaacaacaaatggttgagatagcaaaagcgttgagctttaaatcaaaagtgatcattatggatgaaccgacagatgccttgacagatacggaaacggaaacgctttttaacgttattcgtgaattaaaagaacaacattgtggcattgtatatatttctcatcggatcaaagaaatttttgaaatttgcgatgatgtaacagtattacgtgatggacagtttattggtgaaagtgcggtgcgagatctcacggaagagcgtttaatcgagatgatggttggtcgccgtttagaggagcaatatccgcatgttgaacaagatcgtggttctgttcgtttggaagtaaatcagcttttcggtagtggaatatgtgatgtgagctttaaactatatagtggtgagattttaggtgtgtcaggcttaatgggtgctggtagaactgaattgatgaaagtgctatatggtgctttgcctaaagaaaaaggtgaagtgcggttaaataataaagtcatttctaataattctcctcaagacggtttaagaaacggtattgtatatatttctgaagatcgtaaaggcgacggactaattttgggtatgtctgtaaaagaaaatatgtctttgaccgccttggatcatttgtcaaaagccggaaaaattaatcatcaagcagaaaaaatggtggtagatgattttattgagttgttcaatattaaaaccccaaaccgtgaacagcaaataggcttgctttctggcggcaaccagcaaaaagtggcaattgctaaagggctaatgactcgtcctgatgtacttattttagatgaaccgaccagaggcgttgatgttggtgcgaaaaaagaaatctatcaattgattaataaatttaaacaagagggattaagtattattttggtctcatctgaaatgccggaagtacttgggatgagtgatcggattttagttatgcacgaaggtcgtattagtgctgaatttagtcgtgaagaggcaacacaaggaaaattacttgccgcagcacttgggaaacataattaagggaattgtatgaaatcatcatttaaattgggaaaaatgttattagagcaacgttcagttattgctttgttgatacttattgctattgtatcaatgattaatcctgactttttcagtattgataatattcttaatatcttacgtcaaacgtcgataaatgcgattattgcagtaggtatgacttttgtgattttgattgcagggattgatttatccgtcggttctattcttgcgttgaccggtgcggttgccgcttcattagttagcatggagttatccatttttatggttattccgttaacgctattattggggacttttttgggtagcgtaagcggttttatcgttgcaaaaggcaaagtacaggcatttattgccacattagttaccatgactttattacgtggtatgactatggtttatactgaaggtcgtccgattagtacgggattttctgaaacggcagacagctttgcttacttaggtacaggttatttattgggtattcctttgccgatttggttaatggtaattgtgtttgcggttgcttggtatgttttaaaacactgtaaaatcggacgctatatttatgctttaggcggtaatgaaaatgcaacgcagctatcaggcataaatgttaatagaattaaaatatttgtgtttgcagtgagcggttttttatccgcacttgccggattgatcgtcactgcacgtttatcttcagcacaaccgacagccggtgtgtcttatgaattagatgcgattgccgccgtcgttgtcggcggaaccagtttaatgggcggtaaaggtcgtgttatgggtacattaatcggtgcattgattatcggttttttaaataatgcactgaatttattagatgtttcatcttactatcaaatgatagcaaaagcgttggttatcttaattgcggtgcttgcggataactatttaggtaacaaaaaagcataaactcaatatctttataggagattttaaaatgaaaaaattaacaactattgcatcagctgtcatgttaagtcttgcttttagtggtgtagcaatggcaaaagagacaattgcattagctgtgtcaactttagataacccattctttgtgtcacttaaagacggtgcacagaaaaaagcggatgaattaggttataaattagtcgtgttagattcgcaaaatgatcctgcgaaagaactggctaatgttgaagatttaatggttcgtggtgcaaaagtattattgatcaacccgacagacagcgaagcagtttcaaatgcggttgctattgccaatcgtcgtaatgttcctgtcatcactttagatcgtggagcggcaaaaggtaaggtagtgagccatatcgcttcagacaatgtagccggcggtaaaatggcaggtgactttattgcacagaaattgggtgcaaatgcaaaagttattcaacttgaaggtattgcgggtacatctgctgcacgtgagcgtggtgaaggtttcaaacaagctattgcagaacacaaatttgacgtattagccagtcagccggccgatttcgatcgtactaaaggcttaaacgttatggaaaatttattagcaagtaaatccgcagttcaagctgtatttgcacaaaatgatgaaatggcattgggagcgttacgtgctattaatgcggctaataaaaaagtactggtagtcggttttgatggcactgatgatggtgttaaagcagttaaaagcggtaaattaggtgcaactattgcacaacaaccggaacttatcggtagtttaggcgttgaaactgctgataaggtattgaaaggtgaaaccgtcgcagagaaaattcctgttgacttaaaagtcattgttaaataataaagtgaggacatatttattgtcctcatttcttgatataaacaataagggcgattttgtttattttctgataaggataaatgatgagtaaaactcttactgttcttggtagtattaatgcagatcatgttatttctgtaccgcactttgccaaaccgggcgaaacactaagtggtaaacaatatcatattgcttatggcggaaaaggtgcaaatcaagctgtggcagcagcaagattagcggattttagccaaggtgcaaaagtgaattttattggttgtatcggtgatgacgatattgggcaagcgatgaaaaaagcatttgcacaagatggtattaatgttgcaacgattactgaaattcctaatgaaatgactggaattgcaatgattcaagtggctgatagaggagaaaacagtattgtcatttctgccggtgcaaatgcatatttaacgcctgagattgtagataaatttgcgacagaaattgagcgggcggattatttactcatgcaattggaaacaccgttgaacgcaattttggaagcagctaaattagctaagaaacatggtgcgacagtcgtattaaatcctgctcctgcgagccaattacctgatgaattgctcagtttattagatatgattacgccgaatgaaacagaaacggaaattttaaccggtgtgaaggtaaccgacgagcaaagtgcggcgaaagcagcgagtgttttgcatcaaaaaggtgttgctactgtgttgattacgttaggttcaaaaggtgtttatgtgagtcggaaatcttcgacacaagaactggggcaaaataaggttatagccggattcagagtaaatgctgtagatacaactgcagccggtgatacgtttaatggggcatttttgaccgcacttttagaaaataaatctcttgacgaagctattcgttttgcacatgcggcggcagcgattagtgtgacgcgtcaaggggcacaaccttccattccaactcgtcgagaaacattagactttttggcacaacattaattaatgtaagggcgttgaagatggctacaatgaaagatattgctcgaattgcacaggtatcaacgtccactgtttctcatgtgattaataattcacgttttgtcagtgaagaaattcggcagaaagtcatggcggtagtggagcaactgaattatacgccctcagcattggctcgcagtttgaaagtcaaagaaactaaaacaatcggcatgctggtaactacgagtgataatcctttttttgctgaggttgtggcgagtgttgaacgttattgtcgccaacatcattatcatttgatcttatgcaataccaatgatgacagtatttgtttgcaagaaaatctgcaaaatttgatacgcaagcaggtcgatggattgctcttgatgtgtacggatagtgcctttgaaaccagtcctttaaatttaactgttcctactgtcatcatggattggtggccgacagagctaagtgcggataaaatttttgaggattccgagctgggcggatatttggcgacacggactcttattgagcatcaacatcatgatattgcgattattacgggaaatctgaaaaagcctcttgctcgtaatcgtttgaaaggctataagcaagcgttgcaagaatacaacattcctattcgtgataaatggattattgaaagtcattttaactttgaaggcggaattaagggaatggaacagttgttacaattgaaacagcgtccaagtgcggtgtttgcttgtagtgataccattgcagtgggtgcttatcaagctgtttggcgtcatgggttatctgtgcctgaagatatttccattattggttacgataatattcatttagcacaatatctttctcctccactcagcaccgttcatcaacctaaagatgaattcgcacacttggcagtagatacattgttgcaacgaataaaaaatcctaccgaaagttaccgcacgttgacgttaaaacctgagatagtattgcgtcaatctatttgttcctgttttttgcctaagtccgcatagaaaaaagaccgcaagtgcggtctattatttatctccaaaatttccaccagcttgtgcgttttgcttccggaccttgaatgattgtattattgatatattctttttcaacatcaggtagcggtttatctaaattaacgtcggtgacaataccgcgtcgatcaaaattcacaataaaagtatgttgctcaggtgcattataagatttttgttgtaaaaatacgtagtaccaagtttgattgctaaatggatctattagcattggcgtaccaagtaagtactgaacttgttgtgcattcatgcccactttcacttgttctacagcggtagattctaaatagtttccttgtggaacatcaatacgataaacgattttttgaacactggaacaagcggtaacgcttaatcctaaaatcatagcaggaataataaattttaatcgcatattttgtttaccttaactcgtgcaaataacgtcgtggataataactaaaattcgtaaaattgccaacttattcttttgtttggcgttgtagttgatcgcgtaaattcggcggtagtcctgtaatggttaaactatccgttgcttcatcccaaaatatacggctgtttaataactcggcatcaaaacttaatgtgataccttttcctgagccggaaaatttagtcaacgattttaatgcagtacgtacgggaggaatattttcttctaagccataattttggctgacagcgaaatcaacaaaagactgttcatttagagtgggtatattggcagaaagttccgtgacaacgatttcttcgcctacatttatttgtcctttacaataatcgaatacttgttttttgaccgcttgagtttgttcttttgtcaaatccgcctgttggcagtagtcactaactgcttgtaataaacattgattttgcacttgaggatttaatccctcttctgcacctaaaaaatccataaaaaagtcagcaattttgcgtccaactcgacctttaataaaagtcagataacgagttgattttgcatctaaatgcaattcggttaaattaattcggcaagcaatatcaaattgagtaatatcaagataatgcgtttgttttatttccagattttcatcaaccaacatactatagcggctatctaataatgcgatgaataaataatctgttgcgagaaaattgtattgacacaaaattaacgtgccatcattggcaaaactgtattttcccaactcttgacgtaataattcggctgattgatgactaaatgccaagaaatcaatatcgttttccaatgtgcggttgagtatttgagcaaaatttgaggtttcttggaatactccataggcttttgttttattttgatactcttgatgtaattgcaacatcatttgttctgtttccgctgtaattggtaataattcatcacgtaaatgcgttttaagttgaacggtattttcatcttgtgatgttttaaccaattgatgcaaaacaatttgattaactataatgctcattttgttcaaatcctgtttatgataaaaattcttaatattataaccgcactttaaggaaaatatgctagtatgtgtccaaattattcgtttctatttatatttagcgtacaaaattaaatggcaaaaatttcaaaatttcaagataaacaagtcgaggcaatattgaatgatatgatcgctatactggaaaagcatcaagctccggtagatctttctttagtcgtattgggcaatatggtaacccatttgttaaacagtagtgttgggtcgcaacaacgtattgtgttggcaaaagtattttccgatgctttaatgaattcagtaaaaaatagtaaataatatgtttggaattaaaacaagcaagcaatatcgtgatgaattatctcgtaagattacgtggggacattggtttgctttttttaatattttgtgggcaattgttattggtagtcgttatgcctttattattgattggccgcatactttattcggtaaaatatatttttttattagtttattggggcatttcagcttcattgtttttgctctctatttgctcgctctctttcctctcagttttattataaaaaatgaacgcacttttcgtggtataagcgttattttaacaacgataggtgcaaccttactgttggttgatacagaggtgttttctcgttttaatttacatctttcaaccctcgtttggaatttgttggttaatcctgatgatggtaagttatcttataagtggcaaatattttttgcacctatgccattgattttatttgttcaaatgcttttctcacgttgggcatggtataaattacgcagtttagagagacaaaaatggattaaaggtgttgctcttgtatttgttgttagctttattgctacacatattctttatgcttgggcagatgcgtatatttatcgcccgattaccatgcaaaaatcgaatttccctctatcttatccaatgacagcacgttcatttctcgaaaaacatggtttcttaaataagtctgaatatgaaaaaaccttaaatgagcaaggtcgtcttgatgcgttaaaagtgaattatccaaagcagaaattgactttttccgatgagttgccaaagacgaatattgtccttatcaccattagtggattacgtcatgatgcagttcgacaggatataatgcctaatttatttgcattttctgagaattcaactgaatttactcatcattacagttcaggaaactctcttaatcaaggtttgacaggattgttttatggattgaatgctaattatgcggacagcttacttagcaataaaacaacacctgtattaattgagcggctaaaacaaggaaaagtgcggtatgaaatcggtctatttggtcagaatttatctcgaagtatattattgaagaaaagtatttttgcaaatgagaaaataagaaatgacaacaatgcctttacgcggcgttttattgagtttgttaatactcgacaacaacagcaaaaattattttttgcctatctaaattattcactgaacagcaatttgactattgaacaatattatcaaaagttatctgaaattgatgatgagattggttcggcatttaagtcgatagattttactcataccattgtgatagtgacttccgaatatggttatagttttgatttttctgataaaaaaagaccaactaattattttgcaagagaagtaattcaagttccaatgattataagatgggaaaatttacctatcggtaaagtgaataaattgagtagtcataccgatttggtcccagccttaatgaaacatatttttaaagtaaaaaatccaattagcgatttttctcaggggcaggatttatttgatttggatgataatcgtagttgggttcttgctggtaattaccgttggaatgtaatcattacaccggatgattcgcaatatcatattgataggaatgggcattatcaaaaatacaatcaacattatcaaaaaatttcgtcaacacaacctccgttaggattattcttagaagtattttcacagaatacggctttcatcgaaaaatagatttattagaggtaagccgttttccgagatgagaatgctaagagtggaagcgtattctgttttataaaaaaaagcgtttcttttgtgggggaagaaacgctgaaatgttggagtgattatctattattgtttgagtgatatagatgataattgttctcaaatagcttgtcaataaataaataaaaattattatcaattttttttcttgtctttaattattctaggtaattcactaaatttgttagataaagtgcggtcggtttttgatgagaaaaatcaaattttacagcatagctataaacttcaacaccttctttaactgcttgctgcagtaattcggcataatcaggatcaatagattttgcaacggtgaagcgattaaaaccgtcgtgaagacctgcgaaaaaaacgaccgctctatgtccccgttttttcattgctataagctcacgtaaatgtttctgtcctcttgttgtgacagcatcagggaacaaaccgagatgatttttgacaaacgtaacggattttacttcgacataacaatcaggtaagtttttacctttgagtaaaaaatcaatgcgactattttctacaccatattttacttcaggcaaaatctcatcatattcagctaattctgtgatgattttattttgcaaagcctctaaagttaattgattggaacggtgagtattgatacataccgtttgaccatttttaagttgagttaattcccaagagtgcgggtattttcttgttttgctgtcagaagtagaaaaccaaacagtatcgcctttttcaccacatcctgtcatcgcaccggtattggcacaatgaagcgttaaaatttcaccgttgtttaattctacatctgccaaaaagcgtttataacggcgaagtaatgttgctgattgtaaattcggtaattgcataaaaatccttgttatccaacagtttcagtaattttaccagctttatctgaaaaaaattttgattgaagcaatagttgaaatttttaagaaaatagctttatttttagcgaattagtggtacatttactccgcttgactttttgtcatcttaaaggatgggcgatattatctcccaatttttttaatcaatcaatttgaaggaaacattatgttaattggtgtacctagagaactgcttgataatgaaagtcgtgtggcggcaacgccaaaaacggttcaacaaattttgaaacttggttttgaagtgattgttgagaacaatgccggttttaatgcgagttttgaagatcaggcgtttgtaaatgcaggcgcaaaaattggttcggcacaagatatttggaatgcggatattatttttaaagtaaatgcaccgacagatgctgaaattgcacaaattaaagaaggtgcaacgcttattagctttatttggcctgctcaaaattcagagctaatggcaaaactttcttctaagaaaattaatgtgttagcaatggatgctgtgcctcgcatttctcgtgctcaagccttagatgcgttaagttcaatggcaaatatttccgggtatcgtgctgttattgaagctgcacatgaatttggtagcttttttacagggcaaattacagctgcaggtaaagtacctcctgcgaaagtacttgttattggtgcaggggttgcagggcttgcagcaatcggtgcagctaatagtttaggtgcgattgttcgtgcatttgattcccgtccggaagtaaaagaacaagtgaaatcaatgggagcggacttccttgaaatagatttccaagaagagggcggtagcggtgacggttacgcaaaagtcatgtcagaagaatttaatcgtcgagcgatggcactttatgcggaacaagcaaaagaagtggatattattattaccacagcagcgattccgggtaaaccggcaccacgcttgattactaaagaaatggtggattctatgaaaccgggtagtgtgattgtggatcttgctgcactgacaggcggaaattgtgattatacgcaagccggtgaaattgtggtaactgaaaatcaggtgaaagtcatcggatatacagattttccaagtcgcttaccgacgcaatcctctcaactttacggcacaaacttggttaatttattaaaacttttatgcaaagaaaaagatggcaatatccatattgacttcgaagatgtggtattgcgtggtgtaaccgtaattcgtgatggcgaggttacttggccggcgccgccgattcaagtgtctgcacaaactcaacaaaaaacaaccgcacctgttgtggataaaaaagaaaaaacgccaataaatcctaaagtgaaatatggggtaatggcattggcgggagccgctttcctatggctcggttctgttatgccggctgcatttttatcacactttactgtattcgtattggcttgtgtggtcggatattacgttgtatggaatgtaagtcatgcattacatacaccattaatggcagttactaatgcgatttcaggcattatcattgtaggagcattattgcaaattgcacaaggaaatttctttatcagtttgttggcgttcattgctattttggttgcggcaattaatatttttggtggctttaaagtgactcaacgtatgcttgccatgtttagaaaaggttaaggagaggatgcaatgtctgaaggtttagtacaggctgcctatattgttgcagcattactgttcattatgagtttagcaggtctttctaaacatgaaactgctaaagccggttgttggtatggcattgttggtatggcaattgcacttgttgctaccatttttggaccatattcacaaggattattctggattattattgcaatggcagtcggagccgtcattggtattcaacgtgcaatgaaggttgaaatgaccgaaatgccggaattggttgcaattttacatagttttgttggtttggcggctgtattggtcggttttaatagtttcggtttacatgaaaccgcacaatttctggtaccggaaggtgttgaatatgtcacggacgctgctcaaacattattagcacaacaaaaagcggactttgttgcggaacaatctgtattggcaactattcacaatgttgaggtctttttaggtatcttcattggtgcggtaacatttaccggttctattgtcgcattcggtaaattacgcggtattattaattctaaagcgttaatgttgcctcatcgccataaattgaatttggcggcattgattatttctgcgttgttgatggtcgcatttttaaattcacctgataatatcttccctgtattactaatgacagcgattgcacttgcatttggttggcatcttgttgcttcaataggcggtgcagatatgccggttgtcgtatccatgttgaactcttattcaggttgggcggctgcagcggcaggcttcatgttaaataatgatttgctcatcgttaccggtgcattagtaggttcatcaggggcaattttgtcatacattatgtgtaaagcaatgaaccgctcttttatcagtgtcattgccggtggattcggtaatgatgtagttgcttcatcagaggcagaacaaggtgaacatcgtgaaacaacagccgaagaagtggcggaaatgttgaaaaatgcaagctctgttattattacaccgggatatggtatggcagtggctcaagcacaatatccggttgcggaaattacagcaaaattgcgtgaacgtggtgtgaatgttcgctttggtattcaccctgtagccggaagattgccagggcatatgaacgtattgcttgcagaagcgaaagtgccttatgatgttgtacttgaaatggatgaaatcaatgaggattttgcggataccgatgtcgtattagtcattggtgcaaatgatacagtgaaccctgccgccatggatgatccgaatagtccaattgcaggcatgccagttctagaagtttggaaagcggctaatgttgtcgtattcaaacgctctatggcggtaggatatgctggtgtacaaaatccgttgttctttaaagaaaatacccaaatgctttttggtgatgcaaaagagcgagtagaagatattttgaaagcgttataacaagagaaaaactggtatagaatataactgcactttgctaaaataaagtgcagttatttttttacatttaggaatatgttatggtgcaatatgccttgctcattttgtttagccttgcttcaataatttttattattaactcccattatcgttggacatatttttttgcaataagtcaatttttgttatttattggcattatgtttactattacagggcaatggcaaagagcggttaatttttcttctacattattcattgtttttgtgttgtttcatcgaattaaaatccatttttataagcaaccgcttttgatttcagatttctttttagtcatagattggcgaaattgggaaaccttgttgcattatcgtcaggctttttttgctattatggggctattggttttgttggcttatggtatattcggttggcaaaatacccccgctcttcctttttattggcagataatatcaggcttaatttctattattttaattgtttcaatttgtcattgtacaaagaacaagcaagctatcaaacaatggttagattctttacctgatgatggaagagatgtatttcttaatttacctatgtcctgtcgaggaatcttttataaatcgccagtattttctggaggtagtcaatattttcttgaaaaagcagaagcaattgaaagccataaacaatcaaattcggagcaaaaagcagatattgtagtttggttacaagaatcaacgttaaatccgcatagttttctttttaaacagcacaatattccacctatcacaatgtatgaaaatcaagatgatacaaaatgtaattctcatctgcgagtacataccttaggtggtgcaacttggaaatcagaatttgcatttttatcaggattgccctcaacagattttggtgcaatggctaatgcagtattttattctgtcgttcctcatctaaaatacagttttgttaaaaatttaaaagcacaaggatattattgtgttgctctatctccttttactaaaggaaactataatgcgaaatctgcctatgatcattttggttttgatttaatgttacaaccgcaagatttgggttatccggctcccttaagtaagaatttatggacaatcggtagtgatgaaatgagtcagtatgttcagaaaattcttgataaaaaagatgtgcctcaactaaaagatttacaaaaacccttatttgtttatgtattaacaatgcgtgaacatggtccttattacaactgcggtaatatttttcaaattcaaatggattgtgcaacggagcgagggatcggggaattaaatgattatattcaacggattgtaaatttgaatcaagttatggaagattttaatctttatatgcaacggagaaataagccttatattttaggttattttggcgatcatcaaatttcaataaaagaagctgtaccaagttacagttttaattatccttatccggaatatatcacgcaatttgcggttcgcagtaatttagaaacggattttgaaaagcacgattttttagatttagcatttatagcaggagctattttagaaatagcgggattgcctgtcgatgaatttatgcaaacaaatattaaaatgagaaaattaagtggaggtaagttacaggactgtactgatcaacaattattagagtcttatcgccattatatttattcagaattaaaagtagcggagtagttcattatgaatatgttgcctaattaaaggcgttgctgttaaaaggtataatgaaaaatggttgctaataatatctttctgaagttattagcaactctttttatttaaaagtccttattgacgtcctcccctagctaaagcaaggagattcctaccagctcccattgcaagcaatgggctactctcggaggtttctgctgctgaccgccaatgcgattcacttcacagacgctacgggcacgtcctgccctgattatgccgtcattgagagtctaaagcgacctctgttagcagtaagaagtatatcatatttgtgccttatatctacgccctaaaggacgtggttttacggcactgtctgataaaaactattttttcttcgcatatttcaaggaatcaattgcaacggcaaagataataattgaacctttgataatatattgccaatatggatttacaccaatataggttaaaccatagttgatgacagtaaaaattaatacaccggttactacgcctagtacagtaccaacaccgcctgcaaaagatacaccgcctacaacgcaagctgcaatggcatcaagttcatacataaaacctagattgttggtggcagaaccgatacgtcccgcttctaacatccccccgaaagcgtagaatatacctgcaatcatgtaaatgacgacaaggttacgagtaacgttaacacccgatacttttgctgcttccggattaccaccgatagcgaaaatgtttttaccgaaacgtgttttattccatagtacccatacaaagaaagaagccaaagctgcatagattgtaatataggaaagcttgaaagaacctatacggaaaaagccttgagcaaatgtagagaaactttcgttgaaccctgcgataggtgaagaaccgacagcatcataatagagagagttaataccgtaaacgataatcatcgttcccatcgtggcgatgaaaggtgtgacatttaagaacgcaattacaaccccatttaccaatccaattattgccccaatcatacagactactatgattacaacaggaataggaatttcaccaagttcagggaaaactctatttatattatccattgcttgtaacagagttgccgaaataactgcagctagaccgacttgacgacccgctgacaagtctgttccttgtgtaactaataaacctgcaacgcctaaggcaataattaagcgaacggaggattgcgttaaaatattactaaagtttcttaaacttaagaaacttgagtcttgcataataataattccgagtaagatcaataacacaaaataaattgcgttttgtttaaggaaatctagcgatttgttttgttttaaagcagacataattcatttccttcctttaaagatattttgccgcaagttgtaaaatttcttcttgcgatgttttagctgtttcaacaatttcagtaacttttccgttactcataactaaaatacggtctgtcactcccaataattccggcatttctgaggaaattagaatgatccctttatctttttttgccaattccatgattagctgataaatctcgtatttggcaccaatatcaatgcctcgggtcggttcatcaagcatcaaaatttcaggttgtgtgagcaaccaacgcccaataattactttttgctgatttcctccagaaagtgagccaatatgggtttgatgtgaaggggttttgacattcattgcatcaataacccattgggtatcacttttcattttaatggactttaataaaccaaaatgacctaaataggatttcatattagaaatgagagagttaaattctatgctcagatttgcataaatacctgttgagcgacgttcttcggtaacgagagcaaatccattattaatcgcctcaagtgcggtgcgatttttcatttctttgttatacaatttaattgttccacttttacgctcacgaataccgaaaatggtttctacaatatccgtacgtttggcaccaacaagtccagcaataccaagaatttcacctttacgcaattcaaaagaaacatcttgaatggagggttgatttaatgctgtcagatttttgacttcgagaataacttctttgggttgatttgttttaggggggaagcgttgagttagttctcttcccaccatcatggaaactatttcatccatggtagttttttgtacttcaacagtattaatccatttaccgtcacgcaaaattgtgatttcatcacaaattttgaaaatttcatccattttgtgtgaaatataaacgattccacagccacgtttttttagttttgcaatgattttgaataaatgttcaacttctttttctgaaagtgaggaggttggttcatccataatcacaattttggcattgtaggaaaaggcttttgcaatttcaaccatctgcatttgtgatacagataaattcgctactttctctttgggatcaatatcaatacctaactcatcaaaaatagcttttgtatctcgatacatttttccgtgatcaacaaaaatgcctttcaatggataacgtcctagccataggttatccatcacattacgttgacgcaccaaatttaattcttggtgaaccatggatataccgttttccaacgcctcttttgaggttttgaaattaattggcttgtttaaaaaaagaatatcgccttcatctttagcataaataccgaataagcatttcaacagtgttgatttacctgctccattttctcccattaacgcatggactgagtgagatcgaattgttaaattcgctttatcaagtgcttttacgccgggaaaggatttactgacatttatcattgtaagcaatatttcgctactttgatgtagagtttgtcctgtcatatccaacctcatagaaaaggggagtacatatctcccctaatgattacaacaattattttaagaattcatttaagttgtctttatcaatgccgacataaggaatacgaacaacacgtttttctaatttccagtttgttccttctgttgcaggtttaccttgtgctaaattttttgcaagttgaaccactgctttaccttggttaacaccatcatttagtacggtacctgccatttcacctttcttaattaactgtaatacttccggcaaggcatcgacaccgaaaatcgggagttttttaccatgggctttagttgcttccaatgcacccattgccataccgtcattattagaaataataacctcaatttcgtttgctttagagctggataaccaagcatccactttatcttttgccattgcagcatcccacataccagtatcaatgaacaattgttctgattgaataccctgagcattgagtgcttcaattacgtatttggtacgagcttcagcatccggatgccccggttcacctttcaataagacatattgaattttcccatctttatttaagtcataggctggatttgctttccaatgtttcgcaattaaattaccttgaatgagtccggattctttaggatccgtaccgacatagtaagcgtggttatagcttccaattgcttttgctccgggatctttattgaagaagataactggaatatcctccgattttgcttttttaatgacagttggtgcagcggcagggtcaacaaggtttattgctaatgttttaatgcccttggaaattaatacatcaacctgatcattttgaacagattgtgcattttgtgaatcattcattaacaactctaatccacctacagcttttgcttctttatcgatttcttgacgcattaacgccataaaattatcgtcgtatttgtaaatggttacaccgatacgatcagctgattgtgctgagattgcactaaaacctacagctaaagttaccgcacttaatattgtttttttcataaaatgctccttgattggactggaaaatagatattcttatcgatacttagcctatggtttggcaagccacgacaaggatagccgaaaatgtgtgacaagactgtgatctgtttcacatttatagaaatttatgaaaacgatttcataaaataggaaaattaaggacgttcaactgaaaagcgtcgaactaaagttggattaaattggatatgaacaggttcatcaatttgattgtctactagacttagtgcgagttttgccgcataagttgccattaaatcaataggatagcgtacagtagtcagcttaggaattaaatagcgtgaaatgggcatatcatcaaatccaataatagagaattgtttaggaacttgtatattattttcgttcaatacggaaatagcaccagcagccatactgtcgttatacgcaataactgcggttaaatttgagttataactcaataaattaatcatcgcattttcacctccttcaaaatcaggtgtgctacgtgcaattgcatgttcaacagcgtgaagtttatgatgttctaatgctttcaaatagccattaaaacgatcattttcatctgtaatttgatgatttgagccaatatagccaatatgctgatacccaaatttgatcagcatttctgtagccagaaaggtacctttattattgtctaaacttacacaacgagtttcataaccttgaatgacacggttgatgattaccataccggaaatacgttctaaatattgagcaagctcttgatcacttaaagcttttgaatgaacaactgcatcgtttgcacaataaggtgtctattgcatttctttctttttccgcattgtgatagccaatgccgattaagatacttttttcatgttcttccgcaacgttatctacggctttaactaaaattgcaaagaaaggatcggttacatcagtaacaacaacgccgatagtatctgtatgttgtaaggcaagagcttgagcattggcatttggatgataatttaatttttcgaccgcactttgaaccgctaggcgtgcttttttactggcagaaggatgattattgagtacccgagaaactgtcgcaacagaaactcccgcttgtctagctacgtcatgaattgtaatcatcttattcacccatacggtttaaaatttgcatgaattgccacttatcataaccaaataaattatgtttggaaacggttgttaaactaaaataaaagctacttcacaaaattattatttatctcaatatttataatttaataattgtgatatggatcacagttaaacaaaatagcgatgtgatagcatagctgaaaattatttgtaatcgtttacatttttgcgataaatatcaagtttgagggtataaaagtgagtgaaatgaccgaatttgttgcgacagaacatccgcatcgtcgttataatcctttgacggaacaatgggttttagtctctccgcatcgagctaagcgaccttggcagggacaacaggaaaaaatagctgatgaaaataaaccttgttacgattccgcttgttatctttgtccggggaataagcgtattaccggtgagcaaaatccgaattatacgaaaccttttgtgtttaaaaatgatttttccgctttattagaagatacgcctgaaccactaaaaacggatgaccctttatttcaatccagtctagcacgtggcgaaagcagggtagtttgtttttctccggatcatagtaagacgttgccgttattaacggtagaggaaatttttgcagtggtaaaagtttggcaagaacagctggaggagcttggtaaaaaatatcaatgggtacaaatttttgagaataaaggtgcggttatgggctgctctaatccgcatccacatggacaaatttgggcaaatagttttttgcctaatgaagttgctcggacagacaaggcacaacgaaattacttcaataaacaaggttcgattttgttaatggattaccaaaaacgtgaacgagatttgcaggaaagagtagtaattgaaacggaatattgggttgcagttgtgccttattgggcggtttggccatttgaaatattgttactacccaaaattcacgtgaagcgattaattgatctgaatgagacgcaggcaaaggatcttgccttggcattaaaaatgatcacaaccaaatatgataatttgtttgaaacttcttttccttattctatggggttccattttgcaccttttaatggtgaaaagaatgaacattggcaacttcatgcacatttttatccaccgctactccgttcggcaacggtgcgtaaatttatggtcggttatgaaatgttaggggaaagtcagcgagatttaaccgctgaacaggctgcagcaaggttgcgtgaattaagcgatgttcattataaaaataaataaatttaacggagtgataatatgactcaacaaaatccaaaacagcgagcgaaacagttatttagtgaaaaatttaaccgcacttctgaactgaatgtctatgcccccggacgagtaaatattattggtgaacacacggattataatgatggatttgtgatgccttgtgcaattaattatggaacggcgatcagcggagcaaaacgagatgattatttattttgtgtatatgcggcagatttacaagaatatgatgaatttgatttaactcgacctattgaacccaaaatggaagctaaatggacaggttatgttcgaggtatggtgaaatttattcaacaacattgccctgattttcaacaaggtgcggatttggttatttgtggaaatgtgccactttctgccggattaagttcttctgcatctttagaaattgctgtaggtaaattttgtcagcaactagcggacttatctttaacaaatatagaaattgcattaataggtcagcaggcagagaataaatttgtaggtgcaaattgtggaaatatggatcaattaatttccgcattgggtcaaaaagatcattttctcatgattgactgtcgatctttagatattgttaccatacctgttcctgaaaatattgttgtgatgattgtgaattctcatgtgaaacatgatttagtaaatggcgaatataatatacgccgtcgacaatgtgaaatggcagcccaattttttggcgtgaaagccttacgtgatgtatctgtggagttgttcaaacaaaaggaagcagaattaaccgctcttgatcctgaaatagcgaaacgtgccaaacatgttgtgacggaaaatgagcgggttttacaatcagttcaggccttacaacagggagatttgcaaaaattaggggaattaatgtatcaatctcatgattccatgcgtgatgattttgaaattactgtgcctgaaattgattatttagtggagttggcacaggtcgttatcggcaaaaatggtggagcacgcatgaccggcggaggttttggcggttgtatcgtcgctattgcaccgcaagacaaagtggaggcagtacgtcaaattattgcagacaactatgaaaaacaaacaggtttgaaagaagatttttatgtttgtaccgcttctaaaggagtgacgatatgctaattgattgttttgagaaggaacacaagcaaggaatggcaccggatggacaaccttttcgtatttttacgttaactaatacaaaaggcatgaaagtgcaagtgatggattggggggcaacttggatttcttgtcaagtaccggtaggaaaagaagtacgagaagttttgcttgggtgtcagattaatgattatccgatacaacaggtttatttaggagcgagtattgggcgttatgcaaatcgtattgcaaatagccgatttgagttgaatggtaaacgctatttacttaacgctaatcaacatcagcatcaacttcatggtggaaaagggtttcataatgagcgttggtatttagaaaagtgcggtgtaaattccatcactttttctcattttagccctgatggagatcagggatttcccggtaatttacatgcttttgttacttattctttaagtgaaaccaacaacgtgagaattgaatatgaggcaatttgtgatcaagattgcccaattaatttgactaaccatgcttattttaacttgaatgatgctactttcggttgtgatattcgagggcattctttacaacttaatagcgattattttttgccggtggacagtgcgggtattcctaatgctaagttaaaagcggttgagggaactagttttgattttcgtgaggaaaaaccgatcggtttagattttttacaagaagaacaaaaattggtaaaaggttacgaccattctttcttgcttaatccggacactgaaaaaccttgtgctattttgaccgcacttgatcgttctttgagaatgcaagtgttgacttctcagccggctttacagatttatacgggcaattttctatcagctacgccaactcgtcaaaacgggcagtatgctgattatgctggtattgctttggaaactcaatgtttgcctgatacaccgaatcatccggaatggtggaaatatggtggaataacaaaggtgggtgaaaaatattctcataaaacggaatatcaatttatccgttagatttttaagcaaactctattgaaattaagggggagtattcaaaaaactcccttatttttttctatttctcgcttatatttttgttatgtcatacttttcctgatttttcctagttattcgttacaaaatatgataattttcatgggtcaataagacggaaacaatattacagtttatgagtaacgacgaacagattaatacaatcacagaaaatgaaagtaagaaaaatttctttcactctttatttggacgcttttttcagggtgaattgaaaaatcgtcaagaattagtagacgttatccgagattctgaacaaaatgagctcattgatcaaaatacacgtgaaatgattgaaggtgttatcgaaatctcagaattaagagttcgagatattatgatcccacgttcacagattatttttatcgaaaatgatcaggatcttgaagcgtgtcttgatgttattattgcaagtgcacattctcgtttcccggttatcagtgatgagagagataatattgccggtattttacatgcaaaagatttacttaaattttttcggtctaatgcggagcaattcgaattacaaagtttattacgacctgccgttattgtaccggaaagtaagcgtgtggatcgaatgttaaaagattttcgtgctgaacgttttcatatggcactagttgttgatgaattcggtgcgatttcaggtttagttaccatagaagatattttggaacaaatagtgggggatattgaagatgaatttgatgaggaagatgtggcggatattcgtcagttgtctcgtcatacttatgtagtacgagctttgacggatattgatgattttaatgagcaatttaagaccaattttgccgatgaagaagtggatactatcggaggtttgattatgcaagcattcggctatttaccgaaacgtggtgaagaagttgtactggataatttgaattttaaagttacttcggcagatagtcgtcgtattattcaagtacgagttactgtgccggatgagcaacttacagacagtaaaaaacagaatacagaagaatgagaaattaccttgtttatttcattgctattttaactgggggagtgggcgtattagccttttccccttttgatctttgggcaatcgcctatctttcattagcagggttgatttggattgctaaaaaatcgcaaaaaaagaccgcacttctagccagttttttatggggtttaagtttctttgggattggcgttaattggctcaatgtcagtatttatcaatttggcggaacaccgttaattgtgagctatttactggtcattttactggcaggatatttggcactttatcctgtgttgtttacttatttagtacaacgttttagggtacaaagtttagcgatatttcctgcaatttggacattgactgaatccttacgcagttgggtatttactggttttccttggctacaatttggctatactcaacttgacagcccatttgcgaacttagccgctttgttcggtgtagaagggctgacttttttcgtgatgtggataagtgcggtcatttttagtcttatttctcagctcatacaatcaaagaaacaatgggcaattattattacacatagtgtattgcttgttgtgatgttagggctaagtgcatccactgcgttacttaaatttacacaagaaaatccacaaaaatccctaaatgttactttagtgcaaggaaatattgaacagcaactaaaatgggatcctgattatttttatcaaacactcactatttaccaacgcttaattaaccggagtttagatgactcagatttaattatattgccggaagctgccttgccggccttggaaaatcacattcaaccttatttgcaaaccttacagcaacttgctcaagaaaaaggcgttgaggttgtaattggaacgatttatcaagaggaaagtgaggataaattattaaattctatcgtaaatctcggtaacgctgatgaaccttatcatctaaacacaaaaaaccgttatgcaaaacaccatttagttccttttggagaatatgtccctttagacaaaatattacgcccgttaggttcagtttttaacttgcctatgtcaagttttgcgtcaggagactttgtccaaaaaccatttttagcgaaaaatcgccattttactccggcaatttgctatgaaattatttttggttctcaactacaacaaaatttaactaagcaaagtgattttattttaactatctcaaatgatgcttggtttggcgatagtataggcccttggcaacacttgcaaatggcaagaatgagggcgattgaactgggaagacctgttattcgtgcaactaatactggtattacagcctttattgatgcacaaggtaaaatagttgcacaagctccgcaatttactgaaacgacactgagacataaaatcgttgcaacggaaggtatgactccctatgcaatattaggaactaagccgttgtatttgttaatcagtttattagtattatttagaagtctaggtgcattgatacgcaaaaaattgacgcaaggatagaaaaatattattttgcgaacaggttacagctatttttccagattgtagatgcgataagttctgccggttcttttcttaattgacataattcatggaaaacatgaataattcgctctgaacgattgggttgaccttgaaaaccacaaatgggcatatcgggactatccgtttccagtaataaactgtctaaaggtaattttgcaatagtgtttctggttttattggcacgttcataggtgattgtgccgccaacaccgattttatagcctaaatccacaaaacgctttgcttgatcataacttccggcaaaaccatgaattacaccgcacttatttacttttattcgtttcagaaaagtgaataagtggtcgtgagattggcgactgtgcaagctgacaggcaaattaaagcgttgtgcaaaactgagttgaacttctagaaattcacattgctttttccataatttctcgctaatcagatccgattttcctcgttccagacctatttcagcaattgctgtacaagcagcagaaccttgttctaacgcttgggacaaaatatctaaatcatttttactatgctgttcaatatataaaggatgtaagcctaatccataatacagctgagtcgggtaaagtgcggtcatgtttacaatattttcaaaatctcgctgcaatactgctacaatcagtattttctctacatcaacttggcgggcattatgtacgagttgagccaaattttcctgagtaacttgctgtacataatctaggtgtgtatgggtatcgaaaaaatgcataatgatttgatgctggcaatttgaggaacaatattggctacattacgacgaaatccttgatcgactttttgttgaatgatcaaggaaatcgttatctacaagatgggtaaaaattgtaatatgcttgaatgtaacaccgcactttttgatgaaaatgtaccgacaatatttgtcggtccactatcaaaaatattattcaatggtaacagaagtaataattacatcttcaacaggcacatcttgatggaaacttttgtttcctgttttgacacctttaattttatcgacaatatccattccttcaacgacttcaccaaatacagcatagccccattcttgcacaacggttttaccaaacatttcttttgctcgataatcaaggaatgtgttgtctgctacattgatgaaaaattgagctgtcgccgaatgaggatccgatgttcttgccatggcaattgtgccacgtttattgctaagtccattacttgcttcgtttttaattggtgctttagtatttttttcacgcaagccactttccataccaccaccttggatcataaatccatcaataacacggtggaaaattgtgttattatagaacccctctttgcaatatgttagaaagttttccgctgtaattggtgctttttcaaaatttaatgctaatttaatatcaccaaaatttgtgtgtaatgtaatcattttagatcctttgattttgtgttgttataatgatgcttattatttcataaagttgcaataagtgctataaaatcatcactgagcggattcagcgttctggtagattaacgatttcatttaattatagagaacaaacaaatgttaaaaatttttaataccttaacacgagaaaaagaagtgtttaaacctatttcagaaaataaagtaggaatgtatgtctgtggtgtaactgtatatgatttgtgtcatattggacatggacgcacttttgtttgttttgatgttatcgctcgttatttacgttatttaggttatgaattgacttatgtgcgtaatattaccgatgttgatgacaaaattattcgccgctctttagaaaatagagaaacttgcgagcaattggtagatcgtatggttgttgaaatgtataaggattttgatgcgttgaatgtattacgtccggattttgagcctagagcaacacaccatattgcagaaattattgcactggttgaaaaattaattgcacgtggtcatgcttatgtggcggataatggtgacgttatgtttgacgtggaaagtttcaaagagtatggcaaattatctcgtcaagatttaacacaattgcaagcgggagcaagggttgaaatttctgaaattaagaaaaatccaatggatttcgtgttatggaagatgtcgaaagaaaacgaacccagctggaattcgccatggggagccggtcgccccggttggcatatagaatgttccgcaatgaattgtaaacacttaggtgagcattttgatattcatggtggtggatctgacttaatgtttcctcatcatgaaaatgaaatcgcacaatcttgttgtgcacatggaaaccggtatgttaattactggatacattcaggtatgatcatggtggacaaagagaaaatgtctaaatcgttgggcaacttttttactattcgtgatgtgctaaaccattatgatgcggaaagtgtccgttatttcttgttgacagcccattatcgtagccaattgaattatagtgaagaaaatttggatttggcacatggtgcattggagcggctatacactgctttgcgtggcacagataaaagtgcggttgctttcggaggggaaaatttcattgctcagtttactgaagctatgaacgatgattttaatacgccgaatgctatttctgttttatttgaaatggctcgtgaaattaatcgattaaaaaatgaagataaactgcttgccgatggcttggcggctcgtttgagagaattagccggtattctaggtttattggaacaagatccggaagattttctacaagcaggctcggatgatgctgaaattgctaaaatagaagaattgatcaagcaacgtaacgatgctcgtcaggcaaaagattgggcgagagctgatgctgcgagaaatgaattgacggcaatgggcgttattttagaagacggttcaaacggaaccatgtggcgaaaaatgtagtgattgaaaggggcgatattctcgcccattttgatacgttacggttagattttacttatcagcagaataatataatttaccaatctcaattttctgacgaccatttgcttcacgccatttgtttgtatctcgtaaagaatagacgcaaccgcagtattcttgttggtaaaaacgttctcgtttactgatttcaatcattcgttgcgaccctccgcctttacgccaattgtaatcccaataaaccacatcatcatatttttccgctgcacgatgtccacaaccattaatttggttcatatctttccaacgagaaattcctaagcaactggtaaaaacagggaaaccattttcatgggcatactgtgcggctttttcaaaacgcatatcaaagcacattgtacaacgaataccccgttccggttcatcttccattccttttgcacgatcaaaccaattttgacgatcataatctgcatcaatgaaaggaattccccatttctcggcgaagcgaatattttcttctttacgaattaaatattcttttaacggatgaatattgggattataaaagtaaattgtaaaatcaatgcctgaagcatgaatagcttccatgacttctccggagcaaggtgcacaacaagaatgtaataacagtttattatgtccatgtggtaattctaatttggggcgtacgaaaggtgtattcgaatttttacattctttcttacgacgcttttgtgcatcaaagtgcggttgcttttgttcaagtttggttctgtgcatatctattttcataaggcttgtttgataacgattaaatttaggggaataaatgtttaatttccccactcaagtctaaaaggtttttcattcaaatctgataagtatttttactacaatactcaatgtctaatcattaatagtgcctctcaacggataaataagccaaagaaattaatgcttgcttatattggttttctggtaaacaggaaattgaatcaacagctttttgagcctcttcttttgctttactcatggcataatccaaagatttttgttctgtcataatggcaagtacatcctccaaaaaatcccgttttccgccctgttcgattgcttcacgaattaatgcagattgttgtggtgtaccattacgcattgcatgtaataaaggaagagtaggtttcccttcagctaagtcatcaccgatatttttacccaaagtcgccgcatttgcactgtaatctaacacatcatcaactagttgaaatgctgttcctaagtatcgtccatagtgttgtaaagcaatttcttgttctgcattactttgagctgttatggcggcacattgtgtagcgacctcaaacaagcgagcggttttactataaatcactttcatataattatcttcacttgtctccggatcattgacattcattaattgttgtacttcaccttctgcaatgatatttgttgcatcggacataatttgtaaaatacgtaatgaattgagtttagtcatcaattggaatgcacgtgtataaataaaatcacctaccaatacacttgccgcattgccgaattccgcattggctgtcggatttccacgacgcatatcggactcatcaacgacatcatcatgtaacaatgtcgccgtatgaataaattcaacaaatgcagcacaagtaataggctcatcaccttgataatttagtgctctggctgccaacaaagcaatcatagggcggatgcgttttccaccactttgaacaatgtaataaccaagttgattaatcaaagcaacatccgaattaagttgtgctagaattgtggcattcactttatccatatctgttttaataagagattggattgcattgatattcattgggttcattttttctatcatgctgaaactatcataaattaagctaaaagtgcggttgattgtacctgattttctgagctttctgaaattaaactctataaaataagatttttttattttcttaaaaagaaaggcttgcgaagaagctgtttttttcgtagaattcgcagcctatttatatgaattttgatgtgctaaatgaaaataacattataagcactattatctagcggagtatttatgtacgcagtttttcaaagtggcggtaaacagcaccgtgtaagcgaaggtcatgttgttcgtttagaaaaacttgaattggcaacgggctctactgttgagttcgattcagtattgatgatcgttaacggcgaagatattaagatcggtacaccagtagtgacaggtgctaaggtagtggctgaagttgtgtcgcagggacgtggcgaaaaagttaaaatcgttaaattccgtcgtcgtaaacacagtcgtaaacaacaaggtcatcgtcagtggttcacagaagtgaaaatcactgggattcaagcataatttcacaggagttatagaatatggcaactaaaaaagctggtggttcaactcgtaacggtcgtgattctgaagctaaacgtcttggtgtgaaacgtttcggtggcgaatcagtattagcaggtagtattattgttcgtcagcgtggtactaaattccatgcgggttcaaatgtaggtatgggtaaagatcatactttgttcgctactgctgatggtaaagtaaaatttgaagttaaaggcgagaaaagtcgtaaatacgtttctgttgtagccgaataattttattgatacagagtgatgccccacaatgtttttgtggggttttttgtttttagaaaattaatactttattagcacagttaccagtgcggtgctattattgcacgagttttgtatttatataggagggcgaatatgaaacagaaaccattactcgggtttatatttgcattgactactgcgatagcttggggatctttacctattgcattacaacaagttatgaatgctatgagtatgcaaactatcgtttggttcaggtttatggttgctactgttgcattagctattttacttaaattagcgaacagattacctaaattatcagatctcaatcgttacttttttggactggttatattaggtgttatagggctatccggaaactttagtctgtttaattcctcattaaaatttattgagccttctgttactcaaatttttgtgcatttttcttcctttgcaatgatgttctgtggagttgtgatctttaaagaaaggttaggattacatcaaaaaattggtttagttattctaattattggacttatcttatttttcaatgagcgagcggaccaattatttgatattaatatctattctataggcgtatttttaagtatgtcggcatccttgatttgggtaacttacggactcgcacaaaaattacttttacgccgttttaactctcaacagattttattgatgatttatacagggtgtgcatttgtttttactccttttgttgagattgagcaattgcaaaatctaaatacttttacgctaatttgttttatttattgttgtctgaatacactaataggttatggtgcctatgctgaggcattaaaccattgggatgttgccaaagtaagtgttgtcattaccttggtacctttgttcactattttatttgctcacttattaaatttaatatacccacagtatttttcagcccctgaattaaatacgctcagctatattggtgcgttcattgttgtctttggtgcaatgacctcagctattggttataaatttatcaagaataaaatttaggagaaaaaaatgaaatttattgatgaggcactgattcgtatcgaagctggtgatggcggtaacggctgtgtaagttttcggcgagagaaatttattccgaaaggtggtcctgatggcggtgatggcggtgatggtggcgatgtatatctaattgccgacgagaatttaaatacattgattgattaccgatttgaaaaacgctttgcagcagagcgtggagagaatgggcgtagttctgattgtacaggacgtagaggcaaagatattacattaagggtaccggtcggaacaagagcaattgataacgataccaaagaagtgttgggtgatttaactaaacatggtaccaaaatgttagttgcaaaaggtggttatcatggactggggaatgcacgtttcaaatcttcagtgaacagagcaccaagacagaaaaccaatggaacaccgggtgaaaagcgagatttgcaattggaattaatgcttttagccgatgttggtatgttgggattacccaatgcaggaaaatcaacatttattcgagctgtttccgcagctaaaccgaaagttgcagattatccttttactacattagttcctagtttaggcgttactcgtgttgatactagccgtagctttgtgattgcagatattcccggattaattgagggagcttctgaaggtgctgggttgggagtacgatttttaaaacatttggagcgttgtcatgtcttaattcatttggttgatattgcaccaattgatgagagtgatccagcggataatattgcaatcattgaaggtgaattatttcaatatagtgaaaaattagcgaataaacctcgttggttagttttcaataaaattgatacactttcagatgaagaagcaaccgcacgtgcaaagaatattatgcaacgtttgggtggggaagatgattattacttgatttcagccgcaacaggtaaaaatgtagacgttttatgccgcaatattatggattttattgaagaaaatccacgtcaagaacaagaaaagatagatgctcaagaagtgaaatttaaatgggatgactatcatcaagaacaattgtccgaacaggtctttacagaagatgaccaagaagaggatgattggggcgattggtcggaagacgatgaggaaggtgtagaaattatttataaaccttagctacagaataaaatatgagggtttccttttttatttaaattgaatgttgatattcatattctaagtaggaaactctcagtttttgtagtaagctgtctgagcaatgctgatcttctacagatatatcaccataaaatatctacttgtttttagtgatgagcggttatttttcctacatttttttcgtaaaaaagtaaatagagaaagattgtttttttaatcagtgtttctgcatcagtaactaagatgtctcttcctctaagttattgaaatatctttgccaatcaaaatattgaccagggtctatttttctattcggagatatgtggcaatgtccgacaatacgttgtttggttattaaaggatatgaatgcataatgtctaaagtcagacgttctaaagattgatattgttcttctgtaaacggttgaagatcacttccttccaattcaatgccaatagaaaaatcattgcatttttctctcccttcaaatgaggataatccggcgtgccaagccctatcattgaaattgacatattgtgtaatagcaccatcacgagtaatcaaacagtgtgctgacactcgaatgtttgcaatagttgcaaaataagggtgtgcgagaggatcaaggttacctagaaaaaaatcatcaatatacgaaccaccgaattgctctggcggtaagctgatgtaatgaataactaaaagggaaatatcactattttccggacgttgatcaaaatgtggagagggtaattttctagcctctgaaaaccaacctgtgcagatatttttttgtttattgttcataaattattatttttgcgagtcggctcgcagaaaaagtgcggtctatttgtcggtttttttcaatttctacaaactttcacttgccattcggcattgtcattttatttaaaaaaggaaacattatgaaaataacctatattttttcatcagctaaaaaaggatttactctcatagaactgatgatcgttattgctattgtggcaattcttgcaaccattgcaattccgtcataccaaaattatacaaaaaaagctgcaattacagagctgttacaagcttctgctccttatcgtgcagaagttgagctatgcgtgtataacaatgatgcaccgacaaattgtaatgctggaacaaatggaattcaagcggcaatcaatacaccaaaaggtaaagtaaaatcagttagcgtgcaaggtggagccattactgttacagggaatggaaatcttaaagatattacttataccttaacaccaacaggcgatgcttcaaccggcgttacttggagtgcaaattgcaataataaggccgatctatttcctgccggattttgctcttctacgtctacaaactctccttaaaccattaattacggtgggttgtctcaccgtttcatattaattgcactataaaaagaatttttttgcaaaaatattgcatatttattcaaacggtgataatgtttgcgtaaatcaattaataaccaaaacgagatcttttattcaaatgacaattagtgttaaaaatttaaattttttttatggtgcatcacaggccctgtttgatattaatctcacagctgaagatggtgataccgttgttttattgggaccaagtggtgcagggaaaagcaccttgattagaacgttaaacctacttgaagttccaacatctggagaattgagtattgccaataataaattcgatctctcgcaagatattgccaacccaaagcaaatgcgtcaattgcgtcaagatgtaggtatggtatttcaacaatacaatttatggcctcatttgactgtaatggaaaatcttattgaggcaccgattaaagttttagggatagcgaaagaaaaagccaaagaacaagctattgaattattaaaacgattacgcttggaagaattcgctgaaagatttccactgcacttatcaggaggacagcaacagcgtgttgctattgctcgtgcattaatgatgaagccgcaagttttattatttgatgaaccgacagcggcattagatcctgaaattacagctcagattgtatcaatcattcaagagttacaggaaatgggcattacacaagttattgtaacgcatgaagttgcggtggcaaaaaaggttgcaaccaaagttgtctatatggaacaaggtcgcatcgttgaaatgggggattccagctgttttgaacaaccctcaacagagcaatttaaacaatatttatctcactcacactaatatttaaggagcttattatgaaaaaattacttttagcaacaatgttggcaggtgctacgattggtgcaaatgcacaagatattacttttgctatggaaccaagttatccaccatttgaattaactaatgaaaaaggtgaaattattggttttgacgttgatattgctaacgcaatttgtaaagaaattcaagctaattgtagcttcaaagcccaagcgtttgatgcgttaattccaagtttaattaaaggtcgcggtgggtttgatgcggcaatttcagcgattgatattacggaagcccgtgcaaaacaagtagcatttaccgattcttattatgaaagttctgccagttttattgcattaaaagggaaagcggatttaacgacggcaaaagtggttggtgtacaaaacggtacaacgtatcaacaatatgcgaataaagaagcgaagcaatatcaatctaaatcttatgccagcttacaagatgcaattttggatttaaaaaatggtcgtattgatctcatttttggtgatacggatgtattaagagatatgtttgataaaaatccggaattgcagtttgtgggcgagcgtgtaacggataaacgttatttcaataacggcttgggaattgcggtaaataaaaagaataccgcacttgttgagcaattaaataaaggtatttcggcaatcaaagcaaacggcgaatatcaaaaaatttatgataaatggatgactaaataattttatgtttattgattatttacctttaatgtataccgcaaccctgatgaccttagggttggcggtttgttctttattactcggattggcattatctattttctttgtagtattagaaacacacaaatgggcatgtattcgtaaaccgacagccactattgtgacattattacgagggttacctgaaattcttgtggtttttctaatttattttggcgtacctgaaatactggaatggataatcggagaatatgtagagtttggtgcctttggttgtggcgtggttgcactgtctattatttttgcttcttatgcttctcaatctttgcgtggagcaattcaggctatacctttaggacagtgggaatccggtgcagcattaggtttgagtcgtagttatacgtttatttttcttattatgccgcaagtttggcgacacgctttaccgggattgagtaatcaatggttagtgttattaaaagataccgcacttgtgtcgttaatcggtgtgcatgacttaatgcgtcaagctgaattaatcaacaccaatactcaccaaccttttacttggtatggatttgcagcattgctttatttgttgattacgctatttagtcaatttattattcgtaaacttgagcggcgagtcacacgctttgaacgtgctacaaattaaaggatgaaaaatgattaaagattattttttaacaattgcacaaggaattccaacaagcttgattcttactatagttgccttgctggtagcattttttcttgctttgacattaacttttgctctttctatggaaaaaaaatggttaagtcttccaattaatctttttctcacaatttttaccggtacaccattactggtgcaatttttcttaatctatgcaggaccgggacaattttcttggattgtaaatagttttttatggcctttattatcaagtgcgtggttttgtgcaatacttacattagctttaaatagtacagcgtattcaactcagcttttttatggtgcggtaaaagcgatctctaaaggacaatgggaaagctgtgttgcactaggtttgagccgttggcaaactttgaaaattcttgttccttacgcattaaaaagagcattaccttcatatagcaatgaaataattcttgtttttaaaggcacatcgcttgcttcaattatcactattttggatattatggggtatgcaagacaactttatggtactgaatatgatgcactgacaatttatggtatcgcaggcgtaatctatctcattattacaggtattgctactttattattacgcagattggagcgtaaggtgcttgtatttgagcgtttagaaacggagcgagtgtaaatacacaataacaaataccgaaaagtgatctgtgccttaatttatcgtttatgagttatctatttaagatttaaggaacagatcaatatcggtaatcaccaattgctatttcgtatgaagttttgccaatccgatatcacaacttttgatttgtatatcatgctccatggcgagaatttgttgcttactttgttttaatttactttttatttttgccagttgaacatgtgttcccggctgtttttctgcctcagcaattagattttctgtttctttaaataatttttggcactgctcaggcagagtgtttgcttggacatgagttgttgttatagttgcaaatacgctagctaaaataatcattactgatcttggttttagcattatattcattgataacctcttgaaattttttcagaaaaccttcggaaactatcaaaaaaagactgacatgtctagttatttattgcttcatatttttttgtaattttttactatttggaataaatgttaaaaattgtgaatattctataatgtttgatgtatgtcaatatataagaaagtgttaaagaaatgttatttgatttagatctaaaaatgtgatctttataacacttttattgttttttattcttacttttagtagtaaaattaataccgtttttgggttatccacatgacatttaatagtgaactgtgaaacttatgtaaattttatgttgtatgttcatttaaatgaatgtttatgaggatagttcagtaaatctacttgaggtttcaacttgagtatttgaggggtggttacatagtaatcattgtgaaaaacttgtagcattgcacaaggagttggagatgttggacgttgttgaactctctagattgcagttcgcgttaactgcgttgtatcactttttgtttgtaccgctaacattggggttgtcatttatccttgtgattatggaaactttatatgttgcaacaggcaaagaagtgtataaagatatgaccaaattctggggtaaattgtttggtattaattttgccttaggcgtgacaactgggattacaatggaattccaatttggtactaactggtcatactattctcattatgttggtgatatttttggggcaccgctcgctattgaagcattacttgcatttttcttagaatcaacatttgttggtttgtttttctttggatgggatcgtttatcaaaagctaaacatttattaactacatattgtgtagcatttggttctaacttttcggccatgtggattttagttgccaatggctggatgcaaaatccggtagcgtctgagtttaattttgaaacaatgcgtatggaaatgaccagttttatggatctttggttaaaccctgttgcacaaagtaaattcttgcatacattgtctgcgggttatgtgactagtgcatgttttgttttagctattagttcatattacctcctaaaaagacgtgatgtcggattcgcaaaacgctctttctctattgcatcagttttcggtatcattgcaactgtttcagtattgatcatgggtgatgaatctggttacgaaattggtcaaacccaacctgtaaaattagctgctatggaaggtgaatggcatactcaaccggctcctgcgtcttggaatatgattgttgtacctaatcaggcagagcaaaaaaatgattttgctttacaaattccttatgctgcggggattattgttactcgctcattagacaaacaatttacaggactagttgatctacaagctcttaatgagcaacgagttcgtaacggtatggttgcctatggtttactacaacaattgaaggctgagaaaaaggccaacggtcaggttaatgaagaaactaaagcacaatttaacgcagttaaagatgacttaggatttggtctattactcaagcgttatactgatgcggtcgtagatgcaactgatgagcaagttaagcaagcagctgctgatactatcccaaatgtaggaccaacgttttggtcattccgtataatgatgcttgccggtggtttaattctagttctgatgattgctgcattcgtacaaaatatgcgtaaaacagtagggcgtagtccacttttattaaaagctttattatgggggcttccacttccatggattgctatggaaagtggttggttcttagctgaatatggacgtcaaccttgggctatttatgatgtactaccggttggtgtggctgcgtcaaatttaacaacagctgatctttggttatctattggactgatttgtgccctctatacaatcttcctagtagtagaaatgtatttgatgtttaaatatggtcgcttgggtccgagttcgttaaaaaccggtcgttattattttgaacaattatctaaataagcaggagtctaaccatgattgattatgaatttctacgttttatttggtggattttagtcggggtactgcttattggatttgcagtaacagacggatttgatatgggagttcttagcttattacctttcgcaggcaaaaaagaagttgagaaacgtataatgatcaattctatcgcaccacattgggatggaaaccaagtttggttattgactgcaggcggtgcaatgtttgctgcttggccgatagtttatgcagcctctttctccggcttttatgttgcgatgattttagttttagccgcactatttttccgtcctgtcgggctagagtatcgtgctaaaattgataatccaacttggcgtaaattttgggattggggattatttgctggtggttttgtcccatcattggtattcggtgttgcattcggtaatttattgcaaggtgttccatttgaatttaatgatttgatgcaagtaacttatacaggttctttctttgaattattaaatccttttgcgattctttgtggtttaatcagtttttctatgttaaccacacaaggtgctgcttggttacaaatgaaaacaacatcagaactgcgtgagcgtgctcgtgtaataacacaagtaggtgcttttgttacattgttgacgtttattttggctggtgtttggttatatttcaaagaaggctttattgtaacaagtgtccttgatcataatgcaccatctgacccaactgttaaaacagttgcagttgaagtgggagcttggtttaagaattattttgatgcacctgtgttgtttattcttccagcattagcagtgggtggtgcgttgttaaatattctggcatcaaaagccaaccgttcaggatttgcatttttcttctcgtctatcacgatggcaggaattatattaacctgcggtgttgccatgttcccatttgtgatgccttctatttctcatccgaatatgagtttattaatgtgggattcaacatcaagtgaattaacattaacactaatgcttggttttgcactgttctttgttgttattttactgagctacaccatttgggcttatgcgaagatgtttggtcgcttagatgctgacttcattgaagaaaacaaaaactcattatactagtaaggagataagattatgttttatgtgttatgggtagtgggtgttttgttcgctgttatgctaagtgcaatcattactatcggtcttgagaagactggtaaactcgacgaataaagagttttctttatcaactgaaaaataagggcttctaaagagccctttcatttcttctgttgtgtaaatttttcatgatcaaaagtaaaagtatttttaactaagcactgggtttattttaaggtgcgatgtatagtctaaaaaaatatttttcttttcactgtatttattcttgctaatatatttgactgaatctagaatacttggttcatttttcatatagaaatgagaaaataaaagactttgtgagggagagtaatatgcctgtttttaaattgcctgttcgtgtgtattacgaagatactgatgctggaggtgttgtttatcatgcccgttatctccatttttttgaacgggcgagaacagaatacttgcgaacattgaatttttctcagcaaaacttattaaatgagcgaaaagttgcttttgttgtgaagtcaatacagattgactactgtgttcctgcaaaattagatgacctattaattgtggaaacttatgttgtagctattaagggagcaagtatagttttttcacaaatattgaaacgagatgatgagatcatttcacaagctgtggtgaaagttgcgtcagtggatcttgtgaaaatgagacctgtggctatacctcaagaaataaaagcagaaattaaactaaatgataacattttcggagttatgtcatgaccgctgaattagattttttagaattatttttaaaggctagtattgttgtacaaatcgtaattgtgatattaatatctttttcgattatatcgtgggcgattattatccaacgtagtcgcattttaactcgagcattaaaggacagcacactttttgaagaacgtttttggtctggagaagatttgtataaattatatgatggactttctaatcatcgtaatggtctaaacagcagtgagcgaattttttatgttggatttaaggagtttaatcgtctgaaacaagctaatccggatgcccctgaagccattattcaaggcagttctagagcaatgaatttagcaatgaatcgtgaagtggaagatttggaaacacgagttccgtttttggcaactgttgcgtctattagtccatatatcggcttatttggtacagtatggggaattatgcatgcttttatggcattaagtggtgccaaacaagcaacattacagatggttgccccggggattgctgaggctttaattgcaacggctattggtttatttgctgctattccagctgtaatggcttacaatcgtttaagtctacgtgtgaataaattagagcaaaattatgctaacttcattgatgaatttacgacaattttacatcgtcaagcatttggtaaaaatcattaaatgtatcaaaattctccgtactgacggataaagtgcggttcttttttcataagtttagaggctatctatgtcttatcgtcgaaaacgtcgagatattaagtcagaaattaatattattccttttttggatgtcttattggttttattgctcatttttatggcaacagcaccgattattagtcagagtgttcaagttgaacttcccgaggctgtagaaagccaaaatgtatctaaagaagataaaacgcctgttattttggaggtttcaggtattggacagtatgcactttccattggtggggagcgaactgagggcataacagaagaattagtaactcaactttctaagcaagaatttgacaaagataataatacgttatttttggttggaggggctaaagatgttccgtatgaggaggtaatcaaagctttgaatttacttcatgttgcgggaataaaatctgttggattgatgactaatcctctttaaatataagtaggtaacacagtgtgtaatcatcgacaaaaaaatgagcttggtgccattctgctatcaatttttctgcatattttgttattaagtttgctggtattaggctctaactataataatgttgaaatcatgggaggtggagaaggtgatggtgaagtaatgtctgctgttatggttgatacgggaaccattgcaaaagagtggggacgtttacaggaaaagaaaaaaagcaatccggataaacaagaaacctttgttgaagcaacgcaagaagacgagttaatggagaatgttgatgtatttgaagaaaaaataagagaagatgaagaggtacagaaaagacttgcagagcaaaaaataaaagaagaaaaaattcagcaagagcgtttagcaaagcaattggaagaagataatgccaagaaagaggctgttgcaaagttgaaagcagaggctgaagaaatgcgtttacaggcattggcaaaaaaaattgaagaagagaaaaaggttagagacgctgaggaaaaacaaaaagcagagaagttagcgaaagagagagcagagaagttagcaaaagagaaagcggatagattggtcaaacaaaaggcacttaaggaagcaaaaataaaagcggaaaaagcagctaaagcaaaagcggaattagctcaacgcaaagcggaacaagcagcgttagatgattttttcaatggaggtgatattgcaggaagtagcaaaaatggtggaaatgcagcgatgaaaggttctcaaggagtgggtgctggttttgaaaacggcaaaggcggaagaactggagagcaatatgctgctcaaattaagagagaaattcagcgtcgctttctaaaagaacctaggtttgctaataaagtttgtgttattgaggttgaattagcaagagatggaacgatcactaactttagaaaattatctggctcagacgatatttgtactgcggggttatcagcggtatctagaacgaaaaaggtaccggaggcaccaactgatgagatttatagaaaatataagaaatttccactcgaatttagattgaaataattaaagaaactaaaaggtaaaatttatatgaaattttctgcatatttaactacattattcatagtgctttttagtttgttcatacaaaccgtacaagctgaaagtgaggtaagaattgtcattgatgaaggggttgatagtgctcggcctattgcgataattccatttaaatggaatggtagtgactctatgccgatagatgtagctgatatcatttctgcagatttacgcaatagtggtaaatttaatcctattgcagtcagtaaaatgcctcaaaaaccgacatcagcaagtgaggtaatttccgatgtttggtcttctttaggcattgatgcagtagttgttggacaagttacacccaatgaaaaaggatacagtatcgcatatcaattagtagacactatcggtgcttcaggaaatgcgggagaggtactaagtcaaaaccagtacgctgtaccgaaaaatgctattcgtttaggtgctcataccatcagtgatgaagtttttgaaaagctgactgcaattcgtggtgcatttagaactaaaattgcatacgttgtacaaaagaacggtggctcaaaaccttatcaagttcgtattgcagattatgatggacataatcaatttattgtttatagtagttcgcaaccattgatgtctcccgcttggtcgcctgatggtagtaaattggcttatgtatcttttgaaaatcgtaaatctcaattaattgtacatgatttacagtctggagctcgtcgggttattgctgcattccctgggcataatggagctccggcattttctcctgatggttcaaaaatagcatttgcttcatcaaaagatggtgtactaaatatttatgtcatgaatttaggaaacgggactatttctcagttgactagcggtgcaggcaacaatacggaaccttcttggtcaccggatgggcaatctataatttttacttcggacagagccggcggacctcaaatttatcagatggatgtagttggtaatggtgtatcattagtttctgctggtcgagggtatagtggaaaaatctctgcagatggtagtatattagtgatgatttatggcgataatattgttaaaaaagacctggcgacaggtgtgacggaaatgttaagctctactttcttagatgaaagcccaagtatttcacccaatggaattatgattatttatagttctacacaaggtctaggaaaggtgctacaattggtttccgctgacggtcgttttaaagcacgtctaccaagtagtgacggtcagattaaatttccagcttggtcaccatatttaaataaaaactaggagaggttaatgaaaaactttgcaaaattattagtagtagcgggttcagtggcagtattggcagcctgtagctcatctgataacgcatctaaaacaaatgctcaaatgtttggcggttattctgtaactgacttacaacaacgttataatacagtatattttgaatttgatagttatgatgtgcagggcgaatacgctcaaatcttagatgcacactctgcatacttaaagtcaacaccagcttctaaagttcttgttgaaggtcatgctgatgaacgtggtactccggagtataacatggcattaggtttacgtcgtgctgatgcagtaaaaaactttttattaaataagggtgttcaagctagtcaactttcaaccctttcttatggtgaagagaaaccggcagagttaggtcataatgaagctgcatattctaagaaccgtcgtgctgtattagcatactaatttcttaagccgggtatgatgcccggttttttattgcattttttcagtaaattttgaatttaagtaggtatatttgttttaaatgccccttttctgccgactattcgttcaaataaacaaaaaataaaaaaattttattgattattaaaataaaaacagtaatatatccgctcgttacaaacaatgagggtcgttagctcagtcggtagagcagcggacttttaatccgttggtcgaaggttcgaatccttcacgacccaccattttatttgtaatatcccaatttatgggtcgttagctcagtcggtagagcagcggacttttaatccgttggtcgaaggttcgaatccttcacgacccaccattttatttgtagtatcccaatttgtgggtcgttagctcagtcggtagagcagcggacttttaatccgttggtcgaaggttcgaatccttcacgacccaccagtcatatttaaagattcattcataaaaatattggttattcttatttatcgtgtcttttctgtttgtttctcttaagaggacatatacttaaaattagtcacttttctttttactaaattctatttttgcgatctgtatcgtaattttttttaattatttttacccatttttctagatgagttaaagtgcggtcaaaaataggaaaaaaaatgaaagcattaaaggggtttactctattagaaatattgattgttttactgattatcagtatgacagtaacattttcttttcccatgtggcaaacagcaaatacaaaaatgattttagaaaaagagcaaaataaactctatattttcataagggagctacaagctcgagttgaaaattctaatgatatttggtttttaattgctaatcgtgatttagtgagtaagcgttggtgcctggttgcacaaccaaaaaacacagatatatgtgattgtttaaatcctcgcagctgtaatagaaatattccgatgaaattttattatccttattttgcagataaaaccatgttaatcagcaaagtttattatcctagagaaatgactagattaaatggtacaaggaatacaagtacgacgacttgttttgtgttgcaatctgatcagcaaagaacagtattttcgttttttaatgtaggatctttaaaacttaaaggttaccaatcgttaagtgcttgcgtgaatgatcattagtaagggggaacattgattatttatcgtggacaaactttattaagtgtaatgatagcgttgagcttatcaatgatgttattaatgagtgttagtgcattttatagttatagtcagcaacaaaataaacagatacttttgcatctctatttacaatcagaattgcaacgaactatccaacttttgggtaaggatattcgccgtagtggatttagggctattagtgataaattggttcggagtaatttcgatttatttgaacaagataaaagcggaaagagtattgtagtcgctcaagctgataatgaaccttcgaatagttgcgttctttttatttatgatcttgatgctaccggctgtgtaggtacgacatatcgtaataatgtttgtgtaaggaataaacaaaatacagctcgtgaaattgagcgagagttatttggttatcgcttaaataaacaaatgatagagacaagattaacttataaaaattcaattagcgcgaattgtaatcaaaaacaatgccaaagctatttacaacaacctgcatgtaatagcggagggtgggtcgatttattagatgaaaatgacatagccataactgcattaaaatttcattggattgctgattacaatggattggaagtttatctaaaagggcatctaaagcgaaataaacaagtcgaatatgagacttcagccattattcctttgcttaatcaaaagagataaaaatgaatatacaaaaaggagttgtaacgctcaccctattaatgctgttaagctcagtattattaattttacttttttttgatggtgatttgatttcgttgcattcatccattgtttctcaacgaaaaatatatttagaacaaagtcttatattacagagacaaagtatttctcaaaaagaaaaactttgtgaaaaccagcctctgaataataatttgaaaagtttgaagatcgaatttgaaagtcgacgaaaaattgaccgcacttctcaatttatatggtgtgaaagaaaatatttgtttaaaaaaaggccgaaaaaagctatttatgaggcagggctaagtcagtatataaatcttgagttactggatttatttcaacataaattacattcaccgcctgctattttgccgagagataaagcaaattacctctattgggttgaggaaaaatcagctgaattggagatacaaggtaatattaatgcagttgttattgctgaaggggatttgaagttaacaggaaaaggtaaaattagtggaacggttattaccggcgggaaattaagtattgaaccagcagttaaaattgtgtatcgctcaaaaacaatcatcgatcttatccgatcatatagttattggcagtttgcggagaatagttggtatgattttcaaccattataaatttcctcaacggggtaccagcttgatcacgttattagtcacaatgatgatattttctacattatttttatttgttaatcaatgggttagttatcaaagaaaaagtgcggtaaatatttatctacgttatcaagctttgcaaatcgctgaaaatcaacatcaacgcttatttctagaaccgcattttcattgtccgcataatatcgagcaaaacggttataagtttaagatcaattgtgaaggtaagaatgtacgagtttcttatgcaaatcaacaagtaaatttattgcttgattaattattttgaaaagctatgctaaatgaagttattagaagaataaggaacatttgtgtttactttgtattattccaatcaattggaaacgcaaaaagatattttgttacatttaatgaatcaacagccattatcagatcctttccaaaaagaagttattttagtacaaagtggcggtatggcacagtggatacagtggcagattgcagagaaaaaaggtatatcggcaaatttgtcttttcctatgcctgcaagttttatttggcaattatatgttgataatttaccgcaagtcacagcttcttctcaatttagtaaagaaaatatgacttggcgattaatggaaattattccgcattatatagatcaaccggaattttacatattgcgtcaatatttacagcaaagttatcaatcaagtcagcagcgatactatcaattagccagcaaaatagcagagttatttgaccaatatttagtttatcgaccggaatggattataagttgggagcagaataaaggcgtagaaattattcagcaaattcagtattaccaaaaaaatttatttgtctcagaatcatgtttttctcaagttgagcaacatattgtttggcaaggtattttatggagagctttagtatgctctgtgcaaaaagaaacacaaaagaatgttttacatcgtgcacatctacatttacttttcttaaaacatattgccggcgaaaaacctaaaaatttgcctacgagaatttttgtatttggtatttcagctttaccgaaggtgcatttagatactttaagtgcattaagccagcattgcgatgtgcatttattttttaataatgcttgtcgtgaatattggggagatataattgatcagagccattggcaacgtttgaaagtgcgagagcgtataagttggcaagatttccaacaaccacaaaatacacaggcttggttatccgatgcgcaaatacatacttttgaacaaaatggatttgaacaaatttatgatgaaaagttacaggttggcaatcctttgctttcctcatggggaaaattaggacgggattatttgtatttactcactgaactggaggctaatgaaatcaatgcttatgtcgaactttcggaaaaaacattgttgtcgcaagtacaggcacgcattttagatttggttccttcgaagcacaagtttttaaatttggcagaaaatgaccgctctttaacttttcattcttgttatagtccaatacgagaggttcaagctctacaagattatttgttacatctatttaaccaagctcaggatttgacacctaaagatgtggtagttatggttgcagacattgataaatatgcaccgtatattcaggcggtattcagtcaaggcgaacactatattccgtactctatcgcagacagcaaactttccgaaaatgaccctttagtatctacttttttacagctgttaaatttaaaagaaagtttattcagtgcggaggaagtgctgacttttttggatcatcctgttattcgtcagagttttaatattactttagaggatttggcacaaattcgtcattgggttgagcattcgggtattcgattcggattagaaaaatatccgcaacaatccttgcaaaattataacgcttggcaggcaggtttagagagaatgttactgggatttgctatgcgggaagaaaatggtctatggttagatacgcttggctttgatgatacctatggattaaaagggcagcttgtcggttatttaaaggattttattactcgtttgtatcaatggcatcaatttttgcaagtagatcacgttattgaaaagtgggaagaacatttaattgaattaatgtcatctttttttgtggtagacggaatggatattccgcaacaatacaaaacaacttttaattatcttattgacactattcaacaattaacggagttgatcctagatagctcttttcagcaagaaataagtgcggaggttatttacgaagtttttgttgaacgcttaaaagatatacctaatagcctaaaatttttaatggggaaagtcactttttgtacgcttctccccatgcgatcaatcccttttaaagtggtgtgtttacttggtatgaatgatggtgattatccacgtcaacaaacgccgaacagctttgatttaatgcaatatcatcgcaaaaaaggcgatcgttttcgccgagatgatgatcgctatttatttttagaagcattgatctcggcacaacagtatttttatgtgagttatattggtcgctctattattgatgatagtgaacgagaaccttcagttcttgttacgcaattgttggattatatagctgaaaatattaacgctcaaggtgatctaagaggacaagatattctgaaaaaatcacttattcaacaacatgcgatgactgcatttagccgagaaaatttcaccaaaagagaccgctctttttctaagcaatggctagtgttggcaaataaaaaagatagtggcaatttggcgaattttttacagccgataaatgatacagagatagttaaagaaatttcattaaatgatttaattgcgtttattcaggatcctgttcggtatttttttgagcaaaaattacgtgtttttttacgtaagacagaacaaaatattgcggatactgaaaattttactttagataatttagagttatatcaaataaaagaagaacttatttatctttctgagcaggaatgggaagacttttttgctaggatgaaaattaagggaattatgccgcaaggggcgtttgcaaaaatttatcagcaaaaaacaaaaaatgagatcattacacttaaatctttagttacgccttatttggatcaaatatcggaacaaattcctgttgacttgagcgttgaaacagaatatggaaaagtgtgcttaacggggagcattgacagtttatatcatcaaaaaatgcgaagagtaacgtggagagcctctgctgtcaaaacgaaagatattatccaaacatggatttattatttattacaaaccttggttggagagcctaattcgcaagttgagcattacgctttagacagcagactttcttttgaaaaaatagaaaaatctaccgcacttcaacagcttcaaacttatgttgagtcatatttacttggacaagtttcagtgttattaatgccaatgaaaaatttcgatcaatatcttcaattgctttttactccgaagagtaataaatggaaagaggaaaaggatattgatttatctgcttgttttgaattgttatcagaacttggctcaggtagaaaagagagaaatttttatgtgaaaacagatccttattggcaaagaatattagcacaaacaaaactagaagattcacatattttagaaattaatcaacgtgttatacaatggttcgatttaatgttaatgctaaaaagagttgaatagaaaataaaaacaaaactggatatttatccagttttgttttatccttagtgctttattttacgctatgtaaggtgagatatgattgggcgtgtaacaggaatactggttgaaaaacaagctccggaaattttactggatgttcaaggtgttgggtatgagttacttttacccatgacaagtttttataatttgccggaagttgggcaggaaactacgttgtttacgcattttgtggtgcgtgaagatgctcatttgttatttggatttagccataaacaagaccgctctttatttcgtgaattgattaaaaccaatggagtcggaccaaaattagctttagctatcctgtctgctatgtcagtgaatgaatttgtgtatgcgattgaacaagaagaattatctaaattagtcaaaattcccggagtaggaaaaaaaactgctgaacgtttattggtggagctaaaaggtaaatttaaaggcttacaacaaacagatttctttattaaaagctctcatttacctggaattaaatgctcaaaaccggatcaaagtttgcagttggatgaagcagtttctgctttaattgcgttaggatataagcctattgaagcagagaaaatggttaaaaaagtgttaaaagcagatttaactagtgaacagcttattcgagaggctttgaaagccgcattataagagatagagaatgattgaagtagatcgcattgtaagtgccaatgcaaaagtagacgatgaatatattgatcgtgcaattcgccctaaattattgagtgattatatcggtcaagctcaagttagagagcaaatggaaattttcatccaagcagcaaaattacgccaagatgcacttgatcatttgttaatttttggccccccgggactaggaaaaacaacgttggcgaatattgttgccaatgaaatgggagtgaatattcgtactacttcaggtccggttttagaaaaagcgggggatttggcggcaatgctaacgaaccttgaacctcatgatgtattattcattgatgaaattcatcgcttatcaccagctattgaggaagttctttatccggcgatggaagattatcaactggatattatgattggagaaggtcctgctgctcgttcaataaagctggatttaccgccttttacgctgattggagcaacaacaagagcaggctctttgacttctccattacgagatcgattcggtattgtgcagcgactggagttttattctgtagaggatttagcttccattgttactcgaagtgcggtctgtttgcagcttgaaattgatgttgacgcaggacaagaaattgcttgtcgttcacgaggtaccccacgtattgcaaatcgcctattacgccgagtgcgagattatgccgatgtcaaaaatggtgggaaaattaccgcacttattgctcaagaagcactgaagatgctggatgtggatcttgcaggatttgattttatggatcgtaaattattacaggcaattattgagcggtttgatggcggacctgtaggattggataatttggcggcggcaattggcgaagagcgagatactattgaagatgtacttgagccttatttaattcagcaaggatttttacaacggacacctcgtggaagaatagcaacatcaagaacttatcgacattttggtttggaacagattgaaaaatagcactcttttttcagtcgctctcaacgtgagtcagtcgatagtcaacgatttcaagtaacttgtgggtttgtgcgagtatccttctattctgtagtaaagattctgcaaaggtactatttattgctcaaaattccatttgcacacacataggctgagctccatgcccattggaagttataaccgccaagccgaccggtaacatcaagtacttcaccaataaaataaagacctttgattttatgactttccatcgtttttgatgagatttcttgcgtatctacgcctccaatagtgacttctgcggtgcgataaccttcggtgccgttaggttgaatttgccaatgatgaattaaatcatcaagattttttaactgcactttactgaggttggcaatcacttcatcttgaataatgttgtgatttaaccataaatccactagtttttgcggtaataggcgtgataaggcggtttttaaatgtaatttaggtgaggtctgacgtaacttgttaaggaaaaattgaatattttccatcggtaacagatcaatttctatattttcattcacttgccaataatttgaaatttgtaaaatagcgggacctgatatcccccgatgagtgaagagtaaattattgctgaaagattgaccgcactttgcggttacacaaacaggaagggagatgcctgaaagtgcggtgtaaaatttatcaatttcacgccatgtgaagggtacaagcccagctcgtggagcaataacattgagtccgaattgttcggcaacttggtaaccgaaaggtgtcgaactcaaggctggcatagacaatccgccggtagcaataactaaattttcacattgccaaatttttccgtcagattgcaattgaaaacgagctttttcattaccgtctaatttttcaatgtattcgatctgttgacgtaattgggtattaacttgaaatttatcgcattctgctcgtagcatattgacaatatcttcagcactgttatgacaaaaaagttgccccgattctttttcataatagctaataccatagtcagtaatgagggcaataaaatcccattgggtaaagcgagctagagcagacttgacgaaatgaggattttgcgaaaggtaatgctgaggggtaacattaaggttggtaaaattacaaaatccgccaccggacattaaaattttacgtcccactttttttccattatctaaaatcgttacttggtgcttggctttacctagttgaccagcacaaaacaagcctgccgcacctgcaccgataataattgtttgggaataattcatcattatttattcgctaaaattaccgctcttttgggagccgggtacccttcaatggttttactgtgatcttgaggattaaggaaatcaattaaactttcattttccagccagtctgttttacgttgttcttctagacctgttgtttctacatcgacacaacgaatattatggaaaccgcacttttccagccagtttatgagtgcgagaacggaagggataaaatacacatttttcattttggcatagcgatctgtcggcactaaaatcgtgtttatatcaccctctacaactaacgtttcaagtactaattcgccatctttaactaattgatttttaagttgtgtgagatgatccaatggagattttcgatgatataaaacgcccatagaaaagacggtatcaaaggcggctaaaggttgcatttcttcaatgccgagcggaataagattagcacgacgatcattgtttaacagtttacgtacagcctcaaactgacataaaaacagttctgtcggatcaataccgactaccattttggctccttcgccaaccatacgccacatatgataaccgctaccacaccctacatctaacacaagacgattctgcaaaggtgccaaatgaggcaagacacgctcccatttaaaatccgaacgccattcacaatcaatatggataccatatagatgataaggtcccttacgccaaggcataagctgttttaagtgatgaatgatgcgttgtcgctcaccggaggaaagaggcgtttttgtttcagctttgaccgcacttttgagatcaatatgatcggctgttaagtgcggtagaaaatcaatgatttttgaccatttaatataatcgccatgggtttgcttttcccattgtttaagttgtaaaggcaaagtttcaagccatgctgaaagtgtcgaagttgctatttgttgatagaatggacgaaagtcgaacataattattttgatgccttatatgcgtttttagcttgttcaaacgtctctaaaatcgatttttccggtttcactgataacaaagaaacaacaataatgacaatgcttgccaaagcaaaacctgggatcatttcatataatttagagaattcacttgttgtagggacaatggttttccaactaaatacgataattgtcccagttaacattcccgccattgcagcagaagatgtcatgcgtttccagaataaagaaaatagtacaacaggcccaaaagcactaccaaatccagcccaagcaaattcaactaattttaaaacttggcttttttcatcttgtgcaatccaaattgcaatggcggcaatagctaataccattaaacgaccaagccacatcaattctttatccgatgcttttggacgaataaatcctttgtaaaaatcttctgtaacggcactggaagaaatgagaagttgtgcactcagcgtactcattactgcggctaaaatagcagaaagtaagataccggcgatccaaggattgaacaataattttgataattcaataaagatttgctccgattctttgttgacgacaccagctagttgtggatttgctgcaaaataggcgatgccaaaaaaaccgatacctatggcaccgactaaacaaaggatcatccaagtgatactaatacgtcgtgcgttattgagcgattttactgtgtgtgccgccataaagcgtgccagaatgtgcggttgtccgaaataacccaatccccaagaagccaagctcagtagaccaattgtggtagtaccggtaaaaatatctgtaaagttttttcctaccgcactttcagcctgcttcaagtagaaatgaaaattatctattccgtctaagcttagaataatcatgataggggttagaatgagtgcgaaaatcatcaatgttgcttgaatagtatctgtccaactcactgctaagaaaccgcctatgaaggtataagcaatagttgccaatgcaccataccaaagtgcggtggaataagggatactgaacagattttggaataattttgcaccggcaacgacaccggaagcacaataaattgtgaagaaaacaaggataattgaggctgacacaattttgagtaaattatgacgactaccaaaacggttgtgaaaatattcaggtaatgtgagagcgttattattaaattcagtgtaaatacgtaagcgacctgccacaaataaccagttaaaataagcaccgattgttaaacctatggcaatccaaccttcaattaagcccgacaaatagattgtacccggtaaacccatcagcaaccaggcggacatatctgatgcaccggcagacattgcggtaacaaaactgcctaaacgacgaccgccaagaatgtagtctgaaagattattggtgtagtaatatgcaagtgcaccaatcaataacatgcctaagatatagacaataaaggtaataattgttggatcaaaactaaacattaagccctcacgaaagcattatttgtatagataaaatttaagaaaggtcgcattttaccttattcagggctattattctatttaccttttcgatagactaattaaaagaagtatttttaggatagagatgatggaatctgttgaattattggctaacattacccctagtgaaacccgaattgcactggtggataatggcattttaaaagaagtacatattgaaagacaggcaaaaagagggagcgtcggtaatatttataaaggacgagtgactcgagtattgccgggtatgcaatctgcatttgtagatatcggattggaaaaagccgcttttttacatgcctcagatattgtttcacatacagagtgtgttgatgttgatgagcaaaaacagtttgtagtgaaagatattgcacaattggtacatgaaggacaggatattgttgttcaggtggtaaaagatcccctcggtactaaaggtgcaagattaacaactgacataacactcccttctcgttatcttgtttttatgccggaaaatagccatgttggcgtttctcaacgcattgaaagcgaagaagagcgggcacgtttaaaggaacttgttttaccgttgtgcgatgaattgggcggttttattattcgtactgctgccgaaggagcaacggaaactgaactcgtgcaagatgcggaatttttaaaacgattatggcgtaaggtgttggaacgccgtgcgaaatatacaacacgttcaatgttatatggcgaattggcgttaacgcaacgtattttgcgagattttatcggggcgaatttcagtaaaattcatattgattccaaattatgtttttctgaagtgaaacagtttactgaggaatttatgcctgaactgacagataagttggtgttatattccggcagtcagccattatttgatgtttatagcgttgaaaatgctattcaaacagctttaaatagtcgtgtaaacttaaaatccggtggctatctaattattgaacaaaccgaatctatgacaacgatagacattaatactggtgcttttgtgggtcatcgcaatttagaagaaactatttttaatacaaatattgaggcaacaaaagctattgcacaacagttacaactacgcaatctgggcggtattattattattgattttattgatatgcaaacggaagaacatagagatcgtgtcttggaatctttacgtttggctctatccaaagatagagtgaaaacgaatgttaatggttttactcaacttggtttagttgaaatgacacgtaagcgaacaagagaaagtttggagcatattttatgcgatgaatgtccaacttgcagtgggcgaggcagtgtcaaaactgttgaaacagtttgttatgaaattgtgcgtgaaattattcgagtcaatcatttattttccagtgagaaatttgtagtttatgcctcaagagcggtggcggattatttaattaatgaggaaagtcatggcttgttggcagaattggaagtatttatcggcaaacaaattcaaataaaaacagaagtgtattattcacaggaacaatttgatgttgttgtaatgtaacttccatttttaatatgttatattgacctcatattcattattcaaggtgtcggtatggttaagaatattggaattttatatattgcgacagggcgttatcatgttctttgggaagatttctataaaagtgcggaaaagcattttctacctgaattacctaagaaatattttttattttcagattatgagggaagttttttaggtgaggaaagtggaaatgtttacagaatatatcaaaaaaaattaggttggccttatgatacgttgatgcgttttgatatgtttttaaaagagaaagagcgatttaaagagttggattatctcttttttattaatgcaaatatgatttttattaaagatatacatcaaaatgaaattcttgcatccgataaagagttaattatggcgttacaaccttggtttatcggattagatattgataaaacgacttatgatagaaatccgttgtccacggcatatattccttatggggagggtgagcattatgttatgggaagttttaacggcggtaaaactcctgcttttttagagatgtgtcagcaattaaatgacaatacctatttagatttaaaaaaagatattattgcactatggcatgatgaaagtcatttaaatcattattgttggcgaaataaagagaaaatatttattttgcctgacagttatttattggatgaagggcaaaagtacttcccaagtaaaaagtctcattatattaatcccttatatttaagaaataatgatgttcgattagttatgagaaataagaatcattataggttcggggggggggaattacatgagagggattactgatgaacgaattgaatttagttgggcaactttctcattgaacttaaggggatatcgtcgctatttaaaagagagaattagggcgatatttaaagttctttataagaactaatattgttaatgtaggacaaaaaaccaagatgttaaacaaagtacaagaatctatacttgctccaaataatttagaaccggataatttaaaaaatatatttgatgtgttgtcccatcgtcagattgattatgcagatttgtattttcagcttagtcaagatgaaaattgggtgttggaagacggtattatcaaagaaggcggttttcatattgaccgtggcgttggtgtgcgtgcggtaactggcgagaaaacaggatttgcttattccgatcagattgatttggtcagtttacagcaatgtgccaatgcagtaaaaggaattgctttgccaaatcaaggtaatattattaaaccgattggttttaaagctgtaaatgcggttactcgttatcctgcagtaaatccgttaaatagtttgaataaagagcaaaaaattgaattattacatttagtagaccgtaccgctcgtgcatatagcccttatgtgacaaaagttgtagcgaatttaaccgctctttatgaagaaattttagttgtggcaacagatggtacgttagcagctgatgttcgaccgttaattcgtttatctatttttgtgatggcggaaaaagcgggaaaaagagaacaaggaagtgcgggcgttggggagagagtaggacttgattggttctttgagccttataagggcgaacaacgtgcgatttattttgcgaaagaagcagcacgtcaagcattggtgaatttagacgctattgaagcacctgccggcttgatgccggtagtgttgggtgctggttggccgggtgtattattacacgaagctgtggggcatggattagagggtgattttaaccgtaaaggaagctcattgtttacaggaaaaattggggaattagtcacttctccattatgcactattgttgatgacggcactctaccgaatcgcagaggctcgttgacaatagatgatgagggcgtgccaagtcaatgtaatgtattgattaaagacggtgtcttgcagggttatatgcaagataaaatgaacgctcgcttaatgggtgtgaaaccgactggaaatgggcgtcgtgaatcttatgctcatttgcctatgccaagaatgactaatacttatatgttagcggggcaaagtaagtttgaagatttaattgcttcggtcgattatggcatttttgcaccgcactttggtggtgggcaagtggatatcgtctccggaaaatttactttttccatgtcggaagcctatttaattgaaaaaggcagaataaccaagcctattaaaggtgcaactatgatcggacaaggaattgaagtgatgcaacaagtatctatggtagccgataatatggaaatagaccatggcataggtgtttgtggtaaagatggacaaagtgttccggttggcgttggtcaaccggcttgtaagatagagcaaattaccgtgggcggaaccgcttaattaaactatggtgaatttgtgatttgttagataattaatttttatagagaatatagacagtgactgaaacgactcaatcaaatttgcaattggctcaagcatataacgaactaccttatacttctaaagtttttgctgcttgtcaacctactcgtttacatgctttagctaagattaaagggcttttaccccccccccttagaaacagctaaggtgctggaaatcggttgttcttttggcggcaatttattgccctttgctattcgacaccctaatagccagttagtcggtattgatttatctgaataccaaattaatatcggtcagcaaatgatggaacaggtcggcgtgaaaaacgtagagttggttgctgctgacattagccaagtgagctttaatattaagtttgactatattatttgtcatggtgtttttagctgggtgccggaagcggtacgccatgcaattttaaaaaccatccaagagtatttatctcccaacggtattgctcatattagttataatacctacccagggtggaaaattcgagatgtcgctaaagagctgatgtgttttggaagcaatccgaatttaagcagtttggagcgtatagaccaatcttttgagttattaaaatttacctcttccattttgcaacgaaagaatgctgacttatataaagtattatcgcattcatttcaagaaatacctgataaagataaattttacgtggctcatgaatactttgaggattttaaccaacctttctatttcagggaatttatcagccaacttgaggcataccatttagcctatttaaccgatagttcttttcccgctatttattcagatgtgcattttgaacatgatgaatatgagaaagtgtgtgcctattttgattaccgcttggaagccgtagagcaatttattgatttcctgaataaccgctcttttagacacagcattattacccatcaacaaaatttggcggacaaagggattaccaataatatcagtcaatacaatcattgccatcatttctatgatatctatttcagaacagatgtgcgttatagccctgcgactgatgataaggaagcgcattggcagttgctggacataggtgccgaaatttcggataccccattaaataatttattatgtacttatcttcaagagcataacaatccttgtaaaattggcgatatttgtgagtatgccaaaaaattccccgaatatgacgaaactgaactttacaaattgattctttctattatttattctaatcatgtttatttatgttttgagccagagacatcgaccggctatgacagcaaacccaaattgtttgagccgtaccgaagattgattgatttggtcagacataatcccaatgttaccggcttgtccaatcgatactatcaggtactcaacttagatttcttgccgcaatatatcgcacaatttctcgatggcactagaacagtcaaggatttaatcaaacaattgcgagaggacattgaaaacaataccattgtccttcatgatgaaaacggcaatgaactttcgaataaaaagattaaagataaagacatcaaagaagtgattgttcggcaattggacgcacttaaggagtacggttatttcacggaatataaatagtactgtgtaaattgtccaatcgtgagatagtgtagggagcgtatttaatattgcattgaatacgctctatttgtttaaatttaaactttaaaatcaggtgctaaacaaggttggattttattgagtatttcttttacaagacgtggtgttgctgcaacgatatgactgtcagtgaaatatttatgaccaccgtagaaatcacatactaaaccaccagcttcacgtaaaatcagatcacctgccgtaatatcccaaggtttaacgcccatttcaaaataaccgtcaacacgattagccgcaacatagcaaagatcaagtgcggcagaacctgcacgacgaaaatcagcaacattttcagcaaggttactcatcatagcaaattgggttggcatgagagagggttttttgaatggaaatccggttgccaaaattgcaccttgaaggtcacgtttactgctatcaacacgtaaacgtaattcattaattttcgcaccttcaccacgcacagcggtgaataattcattgcgaataggatcataaaccacgcctatttcagtgcgaccttttacacggacagcgatagatacagcaaagtgcggtaagcctttgacaaagtttgccgtaccatctagtggatctattacccattgaatatcgttgttttgtccttcgtgagcaccgctttcctcagtaataattgtatgctcgggataagatttgcgaacaacttcgataattgctacttctgaggctttatcaatattcgtaacaaaatcatttctacccttttgcattgtttgaatttcatcgcggcgttcataacctttaacaattatattacccgcttttcgtgccgcacgaatagcgatatttaacattggattcatctctttccaccagatttcaaagaacacatggggtgggattatagtgaattttgcctataaaagcgagtagattttaggtttcctaacggttttttagggatcaaataacttttcgtaaattataggggctatgctaaaatacccacaattttaagtaaggtaaaagtcttaatgttggaaaatatcaaaattgttttagttgaaacttctcacagtggcaacattggttctgctgctcgtgcaatgaaaacaatgggactaaatcaattatgtttagttgcacccaaacagggaattgatgaacaggctgttgcgttagctgccggtgctgaagatgtggtaaaaagtgcggtagtggcggacagtttttctcaagctgtagcggactgttctcttattattggcacaagtgcaaggttaagacatttacaaagtaccttaattgaaccgagagaatgtgctgaaaaggtcatacaaagtttgtcatctcaaaaagtagccattgtttttgggcgtgaacgagttggactgacaaatgatgaattattaaaatgccattatcatttaactattccggctaatcctgaatattcttcattaaatctggctatggcagtgcaattaaccagctatgaacttagactagcttggcttgcctcgttaaaagaactgaaacaaccgttttctgtgatagcaaataactatccgacatttcaagaattagagcatttttttgcacataccgaacaactctatcaacaacttggttttattcaaaatcaaggggttatgaaaaaattaagacgtttatatcagcgtgttcaacttgaaaaaaatgagttgaatattttgcgtggtatgttaagtgcggtagaaaagcgaattaattgcaaaaaattagaagttgactaatttagtaggattagtaatatatccgctcaatgtggatctaaaggatattgagaatgaaattaacatcaaaagggcggtatgcggtaacagctattttggatattgcgttaaatgctgagcttggacctgttagtttagcggatatctctgaacgacagcatatttccctttcttatttagaacagctttttgctaaattacgccgtggtggtttagtgaaaagtgtgcgtggtcctggtggcgggtatcagttaggattatctactgagcagatctccattggcatggtaattaatgcagttaatgaaaatattaacgttacaaaatgtttggggaatggcgattgtcaggggggagtaaaatgcttaactcattctttgtgggaagaattgagtgtacgaattgaaaatttcttaaatgaaataacgattgcagaattagttgcaaaacaagccaagtgaaatgagcagtacacgtttgagatagtgataaaaccggctaaaagtgcggtacaagaaaagattttttaggagagagtaatgaaattacctatttatttagattatgcggcaacttgccctgtggatgaacgtgtagtgaagaaaatgatggagtttttaagcattgatggaaattttggaaacccggcatctcgctcacataaatttggttggcaggctgaagaagcggttgatgttgctcgcaatcatattgctgatttaatcggtgcggacagtcgtgagattgtttttacttctggtgcaacagaagcggacaaccttgcattgaaaggagtgatgcgtttctatcaaactaaagggaaacatcttattacctgtaaaactgaacataaagcgatcttagacacttgtcgccagcttgaacgtgaagggtttgaagtgacttatttagatcccaaatcagatggtttgatagatttagaggaattaaaatccgttattcgtgatgacacggttttggtttctataatgcacgccaataatgagattggtgtagtacaggatattgctaaaattggtgaaatttgccgtgaacgtaaggtattatttcacaccgatgcaactcaatccgtcggtaaattgcccattaatttgagtgaattaaaagtagatttactttctatgtccagtcataaattatatggacctaaaggtataggtgctttatatgtttgccgtaaaccacgagttcgtttggaggcaattattcatggtggcggtcatgagcgtggtatgcgttcaggaaccttacctgtacatcagattgtgggtatgggtgaagcatatcgtattgctaaagaagaaatggcaacagaaatgccacgcttaaccgctttgcgtgatcgtttatataacggcttaaaagatattgaagaaacctatgtaaacggttcaatggaacaacgtttaggtaataatttaaatattagttttaattacgttgaaggtgaaagtttaatgatggcgttacgagatattgcggtatcttccggttctgcctgtacatcggcaagtctcgagccttcttatgttttgcgtgccttagggttaaatgacgaattggcacatagctcaattcgttttactgtggggcgttatactacggaagaagaaattgattattctatcggtttagttaaaagtgcggtgaaaaagttacgtgatttatctccactttgggatatgttcaaagagggtattgatttaaacagtattgaatggactcaccattaatagaagagtttagcagtttgttgggtaggtttatcgcttacccattttaagaaatgagaaaaaataggaacgaaaaatggcatatagcgaaaaattacttgatcattatgaaaatcctcgtaatgtaggttcttttgataaaaaagatccgacagtcggtagcggtatggttggtgcacctgcttgtggtgatgtcatgcaattacaaattaaagtaaatgatgaaggtatcattgaagatgctaaatttaaaacgtatggttgtggttcggcaattgcgtcaagttccttaatcactgaatgggtgaaaggtaaatctttagatgaagcccaagcgattaagaatagccaaattgctgaagagttggaattgccgccggttaaagtgcattgctcaattcttgcagaagatgcgattaaagctgcaattgctgattacaaagcgaaaaaagctgaatagttaaagaagattaaaggagtaatgaggtgcatataattttaatattaagccacattattccttttgtgtttagttccctttagttggatttatgtttagataggtagttaaatttctagcagttataatgagttgagaattaactatattgattaaggagaataaatgagtatcaccttaacacaagcagcagcaaaccgagttcgtacttttttagaaaaaagaggaaaaggaataggtttacgtttagggattaaaacgtcaggttgctcaggcttagcttatgttttagagttcgttgatgttttaaatgaagatgatgaggttttcgagcaagatggcgttaaggtgattgtggatcataagagcttagtctatttagacgggactcaactggattttgtcaaagagggactaaatgaaggctttaaatttagtaatccgaatgtaaaagatgaatgtggttgtggtgaaagtttcaacgtataggcaggcatatatatgataaatccatttgcgttatttgatttggaaattgattttaatcttgatcaacaaatactctcacagcgttatttaacgctacaaaaatctttgcatcctgataattttgctcatagatctgcccaagaacaacgtttagcactgcaaaaatctgctgaaattaatgatgctttacaaatactgaaagatcctatcagtcgtgctgatagtataatcaatttgtatcttggtgaacaaaatatagagcaaaaaactaatcaagatatgatgtttttgatgcagcaaatggaatggcgagaacggttggagcaagttgagcaacaacaaaatatggataagttattacacttctcgcaagaggtcgagtgtgtacaacgtgatattttagcggagctacaagaatttctagcacaacaaaattggcaacaagctcaattgctaaatgatcgtttacgttttattaaaaaattatttgttgaaattgaacgggttgaagaacagttagctggtttttagctcagtaatttatttagaaagttatgacgagataatagagtatggcattacttcaaattgcggagccagggcaaagtgcggcaccgcaccaacataaattagctgtaggtattgatttggggacaacaaactctttggttgcagctgtacgtagtggaagtagtgaagttttgcgggacgaacaggatcgcttgcttattccatcgatagttcatttaacagaagatcaagtgattgtggggtatgaggcaggtaaacttgccagtcaagatccgcaaaataccattatttccgtgaagcgtttaattggacgtagttgtactgatgtacagcaacgttatcctaatttgccttatcaatttagtgcaactgaaaatggcttacctctattaaagacaagaaggggattattaagtccggtagaaatttcagccgaaattttgaaaaaattgaccgcacttgctgagcaacgtttgggtggagaattaactggtgcagtgattactgttcctgcttattttgatgatgctcaacgacaaagtaccaaagatgctgcaaagttagcaggtttaaaggtattgcgtttacttaatgagccaaccgcagctgccatcgcttatggtttggatagtggacaagaaggtgtgattgctgtttatgatttaggcggcggtacttttgatgtgtccattttacgcttatccaaaggtgtgtttgaagtgcttgctaccggaggtgataccgcacttggtggtgatgattttgatcatttattagcggagtggattgtaaaaaaatcaacagtcgcacctcaaaatgatcgtgaaaaacgtcaacttattgagcttgcaaaccaaattaaagttgctttgaccacgaacgataaaatccggatttcttatgcagagcaaaatctggaaattatgcgtgatgaatttaattctctgatttcaggtttagtcaaacgttcattattagcttgtcgtcggacgttaaaggatgccaatttaactccatcagatatattggaagtagtgatggtgggcggttcaacgcgtattccttatgttagagaacaagttggtgagtttttccaatgtacaccgctgacttctattgaccctgataaagtggtggcattaggtgcagctattcaggcggatattttagtaggaaataagcctgatagtgaaatgttattactcgatgtgattccgttgtcattaggtattgaaactatgggaggcttggttgagaagattattcctcgtaatactactattccggtagcaagagcacaggaatttactacattcaaagatgggcaaacagctatgtcggtgcatgtgttacaaggtgaacgtgaaatggttactgattgtcgctctttggctcgttttactttacgaggtattccggctatggtggcaggtgcagcacgtattcgagtcacttatcaagttgatgctgatgggttattaagtgttactgcggtggaaaaatcaacaggagtacaagcatcaactcaagtaaaaccttcctatggcttaactgatgatgaaattgctaatatgctaaaatcctcaatggagcatgctaaagaagatattcaaactcgtttactaacagaacagcgtgttgatgctaccagagtcattgaaagtgtttattcggcattacagcaagatgaagatcttttagatgataatgaattaagtgcggttaaaaatgccttagtttcattacaaaaattgattcaagaagaagatagccttgctattaagcaagggataaaaatgcttgatcaagcaacgcaagaatttgcctctcgccgtatggataaatctattcgtcgagcattaagcgggcaacatattgaacatattaaataaaggaaagtagaatgcccaaaattgtttttttacctcatcaagatttttgtcccgaaggaatggttgttgatgctgcaccgggagaaaatctattagacgttgcacataatgcaggcgtggaaattcatcatgcctgtgatggctcttgtgcttgtaccacttgccatgttgttattcgagagggatttgacagtttaaatgagacaacagaacaagaagaagatatgttagataaggcttggggcttagaaatggatagccgtctttcttgtcaatgtgtggtcggagaggaagatcttgtagtagaaattccacgttataatttgaatcatgctaatgaagcggctcattgatccatttatatcaaggtgcatttagcaccttaattattatgctcaaattatataagttatatccaattattctttgctttttgagcgaaaattcagtaatatacaggctttattctcaagtaaaggggatataaatgaaaatccaacatttaattaagcaacatcaacttggcttattgtttcaacaaggctcctttggtttagaaaaagaaagccaacgagtttatcaagacggttcggtagtaacaaccgaacaccctaaatgttttggtaacagatcttaccatccctacattcaaactgattttgcggaaagtcagctcgaattgatcacgcctcccaataaaaatttagaagatagtttaagatggttatccgctattcatgaagttgttttgcgttctttgcctgaggatgaatttatttttccgttgagtatgccggcaggattgccttcagatgaattgataaaagtcgctcaattggataaccatgaagatgtggcatatcgtgaacatttagttcagtcttatggcaaaaataaacaaatggtcagtggaatccattataactttcagttggatccagcacttattcaaaccttatttaatttacaacaagaacaaaaaagtgcggtagattttcagaataatttatacttgaaaatggcgaaaaattttcttcgttatcaatgggttctattgtacttattatcagcgacaccaacagtagagagtaattattttaaaggtagttcgccattaggaaaaggtgaatatgttcgcagtttacgttcaagcaaatatggttatgtgaatgatcctgaggtcattgtttcctttgatagtttagaacaatatgcagaaagtctggagcattgggttaaaagcggaaaactgatagcagagaaagaattttattccaatgtgcgtttacgaggtgcgaaaaaggcgagagatttaattcaaaatgggattaaatatttagaatttcgcttgtttgatctcaatcctttcgagcaatacggtattagccttgcggatgcaagatttattcatcattttgtactattgatgatttggcttgatgaaatgccagatcaacaaggtgttgaattggggcgtagccgtctagcggaagtagctctagaaaatccgttggcacaaactgcctatcgagaagaaggtgagtggttacttaatcagttaatcagtatgttgcaaagtatcggagcagaccaaagtgcggtgagttttgtccgagaaaaattagctcaatttgctgatcccgggttgacgttatgtggtcgtttagtccaagaaattgagcagaaaggcggttatcaaaaattaggtgcagagcttgccaaacaatataaagaaaatgcttttgagcgtttttatgcgttaaccgcttttgataacatggaactttcaactcaagccttaatgtttgatttaattcagcaaggtatcagttttgagatcttggatgaacgagatcaatttttacgcttacaatttggtgaacatgttgaatatgtaaaaaatggtaatatgacttcgaaagatagctatatttctcctcttattatggaaaataaagtggttacgaaaaaagtattggaaaaggcggggtttaatgttccacagagtcaggagtttacttcagttaaacaagcgatagtcggttatagcctgtttgaaaaaagagcggtcgttattaaacctaaatctactaactatggcttggggattacaatttttcagcaaggtgtgaataatagagaagattttgccaaggcagtggaaattgcgttccgtgaagataaagaaattatggtggaggattatttagttggtactgaataccgcttctttgtgttgggtgaggaaacgctggcagttttattacgtgttccggcaaatatagtaggcgatggcattcatactgtggctgaattggtagctcaaaaaaatacgcatccattgcgtggtgatggtagtcgtacgccattgaaaaaaattgcattaggcgatattgagcaattgcagttgaaagagcaaggtttgactgttgagagtattccagctaaagatcaaattgttcagttgcgggcaaattctaatattagtacaggcggtgacagcattgatataactgatgaaatgcatttgagttataaacaactggcggtggggattgcaaaagctatgggggctgctgtgtgcggtgtggatctgattatttccgatttgaaagaaccggcacagcctgatttaagttcttggggcgtaattgaagcgaattttaatccaatgatgatgatgcacatcttcccttatgccggacaatctagaagattaacaagaaatgtgattaacatgttgtttccggaagtaaagtaaataatgtttttcgtaaaataggcggtttttagactgttaatgataagggctggtagtttaccgagaaatttgatttgctggtgtaatggaaaaaatggttgctaataatatatttttgacgttattagcaacgattttgtctattatgctactgcttatggtaagcaattatagtgagtcccccaacaaaacagattctaatgcaatttcgatcatttcattgaaagttaattgtcgctcttctgcactggtttgttcatgcgtacggatatgatcagaaacagtacagattgttaaggctttggctttaaattcagctgctacaccataaatgccggcagcctccatttccacacctaaaatgccatatttttccatgacatcaaacatttctgggtctggtgtataaaataagtcggcggaaaacaagttacctacttttacatcaattcctttattttttgcagcctgtacggctgcttgtgccatgccaaaatccgcaatggcagcgaaatcgttatctttgaaacgaatacgatttacctttgagtcggtacaagcaccaagaccaataatgacatcacgaattttaacgtccattttgaccgcaccacaagaaccgacacgaataattttttttacaccatattctgtgatcaattctttagcataaatggagcaagatggaattcccattccatgtcccatcactgatatttttcgtcctttgtaagtacctgtgtaaccaagcatattacggacatttgttacttcttgtgcattttctaaaaatgtttctgcgatatattttgcacgcaacggatctcccggcattaaaacaacatcggcaaatgcaccggctggtgcgttaatatgtggcgtcataaatgtgtccttttgttgattaaaatattatttttccttaaagcaataaagcaatcgttttcttttacctaaagtgaacacaccacgaaaggtcatggtgtgaaatatggatgacggaattgaaccgcacttttacagtgctgcaccacttaatccaataaataaaccggcaatagttgcactcattaagtttgctaatgagcctgcaattaccgcttttatacctaaacgagcaatatcaccacgacgatttggtgccattgcccctaagccaccgattaaaattgcaatagagctaaagtttgcaaatccacagagggcaaaagtaataattgctttagttttatcacttaattgcaccgttgcatcagctgcaaggtatggtacaaaatctaaataaccaacaaattcattaattgctaatttggttccaatcatacgaccggcaatttccgcttcttcccaaggaaccccaataatgaaggctaacggcttgaaaacccaaccaaagatcatgccaagagaaagtccttcttgaccaatccagtttccgatagtgccaagaattccgttaagtaatgcaattaaagccacaaatgcgatcaacatcgcacccacatttaaggcaagttgcataccagatgatgcacctccggcggctgcatcaagaatatttgttggtttttcttgttgtatttgttcgaaattatcattaaatttttcagtttgtgggataagaattttagcaaataacaatccggctggagcagccataaatgaagctgcgattagataggttagaggtacacccattccggcatatccagccatgactgaaccagcgatagaggctaaaccaccgcacattactgcaaacagctctgattctgtcattttgctaatataaggtttaatgactaagggggcttctgtttgtcccacgaagatattggctgctgccgacatagactcggattttgatgtgcctaatgctttttgtaatgctccgccgatgattttaatcagccattgcattacaccgatatagtaaagtagggagattaatgcggagaagaaaacaatatttggaaggacgttgataacgaaaacaaaaccagctgatcccatagaaccatcggcttgtggcgctaacccattaaatagaaaacggatcccttcattaccataattgatgactgattgtactgctcctgcaacgctttgtagtgcctgacgaccaacgggaacataaagaataaatgcaccaaataaaaattgaattaatagtgcacctagcactgtacgataattaatcgccttacgattattagataaaagaaaggctattaataataaagcgaagataccgataatgctaatcagagaactcataatgtgaatatccttataggtgtgttaaaaatgcacgtattctactcggttttatataaaaaatcttgtactttctaagtgagttatagcttttttaaatttataaatattctttgttttggattaaatttaatttcgattatgattaacacaacgcaactgttgggtcgtaataatgaaaaaatttaatgagcttcctcaaactccttgggcagccaaatctttgtgggaaatagaaacaaaatcgctattggtattatgtttttcactttccttgctcggtattggtgatggattgttggttttatctaatttaggctctgcaccttggacagttttgtctcaaggcattgctttacaagcacaatttagtgttggctgggcatcatttatagtaagtatcttagtaatgttaatgtggattccgttaaggttaaaagttggttttggaacaattctgaatgttgttctgatcgcattatttcttggtttaagtacattttatatttctccgccgagttcccttttagcaaggttttgctatcttataatgggtattattttttttggcatcggaaccgcattttatttgacttgccatcaaggggcaggacctcgagatggattaatggttggattatgtcatcgctttaaattaagaataggaatagtccgtactcttatggaggtttctgtttgttttttgggttttttgctaggcggaacagtaggaattggtacactattatttgctaccagtattggttggattattcaattaggggtttattttattatgaaacttaacaagtcggtctaagaaatatggcattattgccagtcttaattttaaagcatataatctttgccattttattctatatctaaataaacctatgatgagattaccaatcagtgtcacaatgcttgtgaaaaatgccgagaaatatttggcaaaaagccttagttctttgaaagatttccctgaaattattgtgttagataatggatcaacagatcgatctattgaaattgcaaaacaatttactaatgtcaaaatttatcattcacctttcattggttttggaccgatgaaaaatttagttgcaacttatgcaagttatgattggattctaaatattgatagcgacgaaattttacaaccccagcttattcaagagatttctcagcttaatttcgatgaaccccacaaagtttacgcattgttaagaattaatcattaccgtggaaagccaataaaaacttgtggttggtatcccgactttgtgaaacgtttatataataaaaagttggtaaaatttgatgacaagcgagtgcatgaggcattagagattgcagatgatatacaggtagttcgcttaaagcatgaatttaatcattattcttttgatagtagtgagatgttgattaataaaatgcaacattacaccgctctttttgcggaacaacaaaaatatagaaagaaaagtagtgtattgtcagcaattgctcatggaatagttgcatttttcaaaagttatatattaaagagggggattttatcgggaggcgatggttttattatttcttttgccaacgccagcggttcttactataaatatattaaattaatggaagctaatcagagtttaacaactgctttaattataacaacttataatcgcccagatgccttagaggctgtgttagtatccgtattagcacagagccttttgccgaatgaagtaattatcgctgatgacggctcaacagaagataccaaagaacttattcaaaaatatcaagcaatttttcctattccacttaaacatgtttggcaaccggatacgggctttcgtgcagctgagtcgcgtaatagagcattgtctgttgtggaatcggagtatgtgataactattgatggggatatggttttacatcctcaatttatttctgatcaccgtaaagcggcagaaaagaatgtatttgtgggggggggaagaatattgctcactaaggataaaacgaccgcacttttacaatcatcagaacaatattcctcttttaaatggtatgaaaaagggcttgaaactcgttttgaaaaacgtttaatggcgttgcatattcctttcttgtctgaatttatccaaagaactaaaagagtgcattattacaagggtgtaagaagttgcaatatggcattctttttatctgatgctttagaaattaatggttttaataatgattttgttggttgggggcgtgaggatagtgaatttgtcgctcgtttttttaataatggaggaaaaagaaaaaacatcaagtttgcagcgattgcatatcacttgtggcatcctgaagaagatagagaagccttgccggttaatgatgaattacttaaacgagcaattgaagataaattggttttttgttcaaatggattgaaccaaattaaattggattaaatattattctttatatttttgtaacgcacttttcaccagggagatgtaaatagacttgctttttagctaaaaaagagtacaatcttcaggctttttgtctatatatacagagaaaaaagtaagcattcccactcttttgatgtgggttttcttttagtttaaattagttagaggaaggttatggtaaccattcgtttatctcgtggcggttctaaaaaacgcccgttttatcaaatcgtagtagctgacagtcgttcacctcgtgatggtcgtttcattgaacgtgttggttttttcaatccgttagcatcaggtaatgttgaacgtgttcgaatcaatttagatcgtgtgaatcattggattggtaatggtgcatctttatctgatcgtgttgctagcttagttaaagaggctcaaaaggcagcttaattttagcgattttataggtgaatgaaatggaacaacaaagaatagaagtcgttggaaaattaggttcaacatacggaattcgtggttggttgcgtctttattcatcaacagaacaagctgaaagtatctttgattaccaaccttggtttttaaaaatcaaggggcaatggcaaccaattgaattggaaagctggaaatttcataatcacgagttaattgttaaattaaaaggcattaatgagcgtgaggtcgcacaaactttggcaaatgttgaaatcggagtaaatttatccgtttttcctctattagatgagggggatttttattggcatgatttaatcggttgtcaagttgtgaatctacaaggttatgcaatgggtgttgtgtctgaaatgatggaaaccggtgccaatgatgtgttggttgtacgtgcaagtacaaaagatgcttttggtaaaaaagagcggttgattccgttcttatatgaacaagtagttaaaagagtggatctcagttctaaaactattgaagttgactgggatgctggtttctaacctcaggtaatctgtaacgctttggcagtaacataaacacagaaggtaagtaaatgtggatcgggattattagtctatttcctgaaatgttcaaagctattacggaatacggagtaacaggacgagcagttaggcaaaacctgctggagatacaatattggaatccgagagatttcacctttgataaacataaaacggtagatgatcgcccttatggtggaggaccgggaatgttaatgatggtgcaacctttgcgtgatgccattcattgtgcaaagtctgtggcaggtgatggtgtgaaagtgatttatctttcgcctcaaggacgtaaactggatcaaaatggtgttcaagagcttgccagaaatcaaaaaatgatttttgtttgcgggcgttatgaaggcattgatgaacgattgattgaaactgaaattgatgaagaatggtcaatcggagattatgttcttaccggtggggaattgccggcgatgacgttgattgatgcagtcgcaagatttgttccctgtgttttgggtaaacaagcctctgcacaagaagattcttttgcagaagggctattagattgcccacattacacaagaccggaacaattaaacggtttaactgtacctcctgtattgatgtctggtaatcatgaggaaattcgtaagtggagattaaagcagtctttgcaacgaacatggttaagacgacctgagctattggaaagcctagctctgactgacgaacaaagtaagctgttatcgcagattaaacaagaaaacagttaatcagttaaatctaggatctaagaaggattactacaatgagtaatatcattaaacaaattgaacaagaacaattaaaacaaaacgtacctagcttccgtccaggagatactttagaagttaaagtatgggtagtggaaggaagtaaacgtcgtttgcaagcattcgaaggtgtggttattgcaattcgtcaccgtgggttacatagtgctttcactttacgtaaaatatctaacggcgtaggtgttgagcgtgtattccaaacacattcaccaattatcgacagtattactgttaaacgtaaaggtgcggtacgtaaagccaaactttactatttacgtgagcgttcaggtaagtctgcccgtattaaagagcgtcttggtaattagtttattagacttatataaacaaccccttggatactccaaggggtttatttatagaaagattggcacgttttgacattaaatcataaaatacaaccattaatagaacattaagtaatatgatgaatgagcacatattacaataatgaaaaatgcaaaaattccacaaaatgatctgcccagtgtttttcatgatgaatttcatttgccatcattcgtaagcgaatgttatctaatggatgacctgtgcgtaataaggcttggtaataatggagtgtgcaatcaatataggcttggttcatatttgaaataaataatgaatcaacatcatctccttctttagtgcctacttgaataaagactttactatttttatcaattggattgtggtggataaaatgcagaaaatctttttcactaaaccaagacgcgagagaaaaaacacctaaatgtccaaaaatttgtggatatgctgaccccatataggcagtgataattcctcccatggaactaccagcaagcaaagtatgttctttttgtggtttagtgcggtaatgttgatcaatgaatggtttaacgatctcaactacccatttgccgtattccatacctttcccaccgcactttttaatttccggtgacgagcctacgtcagtacgccaaggtccatattcatcaaggcgatctacacctgaattatctatgccaacaataataattttaggaaattctttatggtgtttaatggttggaataattttccaagagtaacctgagtaagattctttactataaaaaatattttgtccgtcatgcatatagagtactgcataactatcccacgtatcggtgtaataatcttttggcaataacactcgaatacgacgagtgcggttatagtaggggacgtaaagaaaatgttcttccatttttaaataataattagtatttttcacaacaaaaaccttataaacgtaaaacaaagtgattttttaaatactttcacctaaatgaatattatatccgagattgatcatgtaattttcaggtacaataccttctatacgattcagtaattcttttgctgccacttcaccgatatttaagcgtggtgtgcgtactgtggcaatttgtgtcgttaaagataatccaacatttaacccatggaagcctgcaataccgatttctttaggtacgtcaattccttgacgttgacattcaaataacgcaccaattgctaaatcatcattggtacaaaaaatgccatcaatttggggatgtttttttaatgccagttttaattgttccgcacctaaagtaaatgatgagggttcttccgtgaggagactgtgaggtgtcagttgatgttttttcattgcttgttcgtaaccctgcatttttaaacgggtacgtttatccatacgagcagagaaatagacaatatttttatagcctcgtttaatcattgtttccaccatagactgtgctgccgctatattgttgaaccccaccacttgttgtaaaccgaattcgctggtatccataatttcgacaacgggaatatttgccacatctaacatttttagcgttcttgccgaatgttctgtttccgacaaaataagtccatcaatgttataagagagaagcgattcaattcgtttttcttctttttcttgacaataaccataatgggctaacatggtttgataacctgcttgatcggtaatattctcaatacctttaattacatcggcaaaaacatgatttgttaaagagggtacaagtacaccaattgctttgcttttcgcattggataaaatttccggtgcacgattaggaatatatccgaagtgttctatagcttcggcaatacgcacacctgtttttggtgcgacaagacgtggatcacgcaaataacgacttatcgtcattttagtaataccaagatgagaggcaatatcttgcaaagtggggcgtttacgtttatcgggcattttttatcctaacataactttatttctgtccattttgccagcaatatgcctgttgcaacagaaacattcaagccgtgttttaatggattaactaatgacaaattaatcagttcatctgctttatccgctaatgattcagtatcagcttcactcagtacaaatgcaactttatcattgagttgtaattgcttaatggttttggcgtgtttatttgagcttagatgaacgatttgatagcctgcttgtcgcaatttaaccaatgccgtttcagtgcgatcaatttccagcggatgaatatattccataccgccttctgccactcgcattgctactgcagaatgaagaagttcaacatcgtcaataacaaccgcacttataccataacatacacaagtgcggataattccgccaatattatgtgcattacgcacaccatttaaaaccaataggcagtttttttggtgtggaatatctaaatagccgtgcaaagtaaatggacggcgttttttgaccaacatgcaaataccaccatgatgttcagtgccgctgactaaggctaactcgctattatctactacatgatagacttttttattgctggctaaatagctaaacaaatcccccactttatgtgccatttctaccgtagtccaaacacgcacaatactttccggacgttgtgcaaaaagggataaacaagcattttcaccatatactttcatttcctctgcacgatttttcttgatcttctccggtgcacgtggcgataaagggccagttttcttttcagtttttgcaactaaacttgaacgttttagcacaacttgtacttgtcctgtaccgtttggcttttccatagtggtattgataatatgagtgtgggaagccgtattttgtgtattttgagggcgagagtgccgattggataaagctcgctttgagttattgtcaacgtgcggtgattttgatgtagatttttcatatcttttgttgctgacaaagcgttcagcaaagcgtttttcattatttgcttgttgaaaaattggtttttttgtcttcatgttggatattaatttaaggttagaaaaagataaagtgagcaaaaaaacaccgcactttatagagttttgtgaacattataacgaaaaaataccttttttctaccaagttaccgactaaatattgtaaactagccagctaaacacaaactcgtagagaagtgaattatgttgatcaataaaacaaaacgggcgaaacaaaatttggagcggttaccttgtattcctttgcaagcagagcaagttgagtttatttatcattcttcagattttaaacaacagattattcagtgtattcgtcaagcaaaatcaagaatttatttcaccgcactttactggcaaaacgacgaggcgggacagcaaatcctagatgagatttatcgtgctaaacaggcaaatcctgaattagaggtaaaaattttggttgattggcatcgtgcacaacgtaatttacttggtgctgagaaaagtgccacgaatgcggattggtattgtgatgaacgcagtaaatatcagttggctgacgatcctaatatattttttggtgtgccaatcaatactagagaagtattcggtgtattgcatattaaggggtttgtgtttgatgatacggttttatatagcggtgcgagcattaataatgtgtatctacaccaacaaacaaaatatcgttatgatcgttatcataaaattgaaaataagagattggctgatattttagtcagctttgttaagaattatttattcgatcctaatgtggtttatccgcttgattccggtgatcgtcctaaaaccaaagaaattcgtcagtatattcgtaattttcgtaaatatcttgccggtgagggacagtattatgtggaatcttcagtgaccttaaatgacagtttgacgatttgtccattatttgggttaggtgcaaatcataatttacttaatcaaaccattgaagatttatttcaagttgttgaggataagttaacaatttgtacgccttattttaattttcctcgtttattacagcaaaaagtacgccgtttgctggctaaaggaaagcaaatagaaattattgtaggtgataaaacggctagtgatttttatattcctccatcagagccttttaaaatggcgggagcattgccatatctttatgagaaaaatttgcgtcattttagtaaaaaatttaccaagcaaattgaacaagggcagttagttgtccggatttggaaagatggtgaaaacagctaccatctaaaaggcatttgggttgatgattgttatatgttgttgacaggaaataatttaaatcctcgtgcttggcgtttagatgcggaaaatggcttatttattcatgatccgaaacaacaattacaaacacaaattcaacaagagctgacctatattcttcgaaatactactattctaaaacattatactgagttaagtgatctgactcagtatccgaagccggtacaaaaaatattgaaaaaatttgcccgcattaaagcagataagttagtgaagatgattttgtaagggttattcaaagcacttcatttcaaatattaaccgatagatcggcgataaatttcgccgatttcttttgaactcttaccaaacaccttttctaattgtgccaaaaaaagctcaccggcagatattgcatcaataagtgcattatgaccgatatattcgggcaaattatatttattacgaatatggctaagttgataattattttcgttgtcctgacataacgaacgttcaatttttaaggtatctaaccaaaacagaggaaattgcgataaattatagcgaacgttcagataatgtaagataaaacgcttttctatagtggagccgtgagcaataagaatacgtccttgcatcagctcaaagagtttattcattgtatcatctagggtttctgccccatttagcatttgtggcaaaatatgattgataataacagtatcttctttaatttcttgttgctcggcgacgaattgatgccatgcttttgaaatatctaatgttaaattgtcaatgggaacggtagcgacactcaaaatattatccatcattgaattcagccctgtggtttcgaaatcaattactaagtaggaaagtgcggtcaaatctgtggaacttttggggtaaggcttttcaaataaccttttccattgcacgggtaaattatcttgattaataaagatttttcgctgtttttccaatttattcaacggatgaaatttgttgaggaaattttttatcatctcattattcctcgttgtgaaaaacgtatctctgccgcctcttgaaattgggcaattaagcgaaaagcatctttaaggtgatttcgttcaagggcacttaactcactgggatcgatatgattagttagttcttgctgttgttgcaatgcgtctgattgatatttaaaacgcatattgcagacaaattgatatacctccagtgcattattaagggtttctttattcagaataccttgcttgtaacaatgtctaaaacgctgttcagttgacatagtttgtgctaaaccggcagcaagtgcgtaaattcgtgcaagatctactaataaactgatagcacgttttttcaagttaagtttatttttatgttcaccttctttaataagaacaaaatttcggaaaatacttaatgggggttttactcgaatactgtttgccactaagaacgctaaaaagcgtttattgtgtgcgactaaatcgacaaaatattgctgaagttgatctgccaaattaagatcaccgtaaatacctcgcatatccataaatacagaggcattgagcaaaccttctaattcaggtgcaataatccaactacggaaattttctttccattcctgtagagaaacacaccagcgtgcatttattgccatatagttacccgtgcagtaaggatagccgcattcatgcaatccattgtttacaaatttagttagttgtacaaaatactcctgttcaagtgcggttaattttctttctaaaatgattgcattatcctgatctgataaagggtgcatttcataacgagcctgtgaacctgctacaacccaagcatagcgacagggtggagttcctaattcatgttcagccatcatgagcaacttacgggcaaatgcatcagcgataagcgtcatgacgtgcataatattattataagcgacacctctctctagtaaagcacggaataaatcccgttgctgtttagctatttctacaagcaaaggcagcgtatttgcttgaaaaatacggttaatgataaaaacagattgcatactgttttgttttacaagatctgtggcggttaaaataccttgaactttatcatcaacaatcaccggcaagctacgaatattatgttgcatcatcatggaaatagcttgtagtactaattcatcacccctaatcacaggaggattaatgttcatgatttctgtcactaacgtatttacatctaagccttgtgctacaacttttttggtcatatcccgatcatgaataatgccaatcaatttgttttgttgcatcactaaagcagaagaacggcgttgttcacacattctaatcgcagcttgttgtaatgtcgtattcgtatcaacaagagcaattttaggattagcaatatcaatcacttttttcatgaaaatatcattttgattttttaaaaagttattttttgccaaactgtttaatctttttcctgcatcagaagaaaagtaagaagcgtactcaggaaatttttttaaaagttcatttaagcgttgaaaaggaatttgataaattaacgtattttccaacgcataagcctgatatttatcttgctcgtgatgattgaaaatactgaaaccaaaacaatcgccactttccaatcttgctcttaattgtcctgatttattgacttgctccactgatcccatacgcacaatatacaagttttcattattattgaggctatcgatttcatcatttgtgattagttcccctttggggatataacgaatttcaatattctgtgcagcaagacgaattaaatcatgaggtaaatgtgtaaaagggggaacctgtgcaataaataattcgatattgggaataagtgagctatccatgtgagacctttgttttatcgaaagtgagctacaactatagcagaaattaacccgacacagctgtatcgggctaattacatttagtgtttttgagaagataattagtttttacgatttttccataatttaattaatcttctataacgctctgaggtttctttgatgagttgctcatcatcaattttaccagctaaccaatcagccgaaggttgtccaaaaattgttctgcctacagcaaacccttttactaaaggtgcgtttgccgacgctttaaacacattctcaaagactgcttcaggtgcgtctaagccaaggattaaaataccacgacaatgtttgtcatttttttcaatgacttgactgatgtctgcccaagtttttgcggacactccaggtaatttccaccaatccggtttaatgccgagagaatagaagtgggcaatcatatcggtgtagtaactttctttttgctccatatccgcaggcaaaatgatctctagtaataattcgtgacctgtacgacaacaagcacgataaacttcttttaatgttgcatcttgatctgcttttaactctgccttgtctgccggatgatagaatgctaaacatttaacgacatgttctgcgggccaactaatgagttgactacctaaatcaccatgctctaaacgcaatggacgagaagatggcatttctattggacgaccaatccaccattttttaccagtaatttcattgagtgcttcttgaccaaatgtggtatcagctaaaacgccggcattgccattataaatcccctctttttgagcggtttgttctgcggctttaagtaataacgttttgagtgttggaatacgtttcaaatctgcaccgcacttttcagccatatcaaccaattgtttacgatgatcaaaggcaaaaatacataaatcatgccattgttgcttgcgtgttgtaacacggtgtaaatggtttaattgttcgtctaagtccggtcgaggtaccgattccgcacgggagagataattatctaattcttctttagtcggcattgccggggcacaaccatggcgagagacgaccaacgcaccgcaagcatttgcataacgacaacattgctcccaactttcaccgttaatatagccacgtaataaacctgacataaaggcatcgcctgcacctaagacattcaaaacttcaacacgtacgccatatacattaataccaccgtcaatatgattcggaatatcgccctcaaagacagagcaacctaacgccccacgtttgcaaaccaacgtagcgttactgactttacgtacattttttaatgcagttagcgtatcagttgacccaccagcaatatgaaactcctcttctgtaccaactaagacatcaaagtgatgtaaaacttcttgtaaagattgtgtaacggcttcagagtcaataaaacgagtttcaccatcacccaatgaagttaatccccaaagtacaggacgatagtcaatatccagtaaacgttttgttccattacgacctgcgtattcaagtgcggttaaaaccgcatggcgagtttttggatgggataaatgcgttccggtaatagcaagtgcttttgccgaagcaatatattcttcatcaaaatcatcagcggtgattgccatgtctgcacaattatcacgatagaaaattaatggaaaagtatcttgatcttttattcctaaaatcactagagcagtcagccgctctttatccgtaatcaaatggctcgtatctacacctagacgctgcaattcctcacgtaagaaacgtcccatatgttcatcacctacacgagccaacatagatgattttacaccttgtacagccgttccataagcaacattacctgatgagccgccgagatatttagcaaaagagctcacatcctctaagcgtgaaccgatttgttgagcatataaatctacggcaactcgtccaagacaaataagatctaatgttttttcttttttcattgtgcttctccttgcgtgatgaagtcatcacaaaaaacggatatagaataaattattgtcttaaattgaaacatatatttcaaaaatgtctagaaataaaattaatatttgagatattgatcacaaagattagctatctcgctggtatataaagtcttttaagtaaaataagaatgaaatttccttttcaaagtggtataaatttaacttattactgagagaaatacaaaggaagagatagtatgcaagaacattctcaactcgttacattacaaaatgaaatctgttcacgttattcgactttgagtaaacgtttgaaacaggtagcacaatatgtccttgataatcacaatagcgtaatttttgatactgttgcgacgatatctgaacgtgccggtgttcctccttctacgcttattcgcttcgcaaatgcgtttgggtttagtggctttaatgaaatgaaacaaatttttcgtgaaaatttgattgaagaaacggcgaattatacggagcgtttacaagtttttcgtcagctggaaccggaaaagagcgagcaacataatctgcaagatattttgaatatttttgcacaagccaataaccaagcactaaaacaattaagtagccaaactaccacaaaacagttaaaaagtgcggtagaaatattaaaaaatgcacagaatatttttatcattggattaaaacgttcgtttagtattgcctgttatttggattatgtgttgcatcatttagattgtcgttcttttttaataaatggattaggcggcatgtttgatgaacaattaatgcaagtgaaaaagggtgatgtcatcgtggcggtgagtttttcaccttatgccaaagaaacgctggaaattgttagtgcaacctcacaaaaaggtgtcaaacacattgctatcacagacagtcaaatcagcccgttaattgcttccagtgatgttgcttttgtcgtgaaagaagcacaagtaagcggtttccgttcacaatgtgctacgatgacattggtacaaactttggcgattttattaggcttagaaaaagagaaagaaacacaaaattcttaaaaataacgattaagacttggtgatgaatgtcagcaactaagttttgagataaatatcaaaacgatgatttttggtttggtgactgaagtgcggtgtttttttagcaagaaaatctgcgtaatcgggacgctttactaccgctcttttttgtgcgagcaataaggcaggttctaataacatatcagcatccaaatctgcaccgattaaatgttgaaaaatacgcatttcttttttaaccaacgcacttttttgtttatgaggatacatcggatccaagtagacaacatcagcaccttcttcactcgaatttaattcttgaatatgtgctatgtccagcaattgcatattcgcctgcatcatagtccctatttccgcatcggcataagcacgcttcaagccgtcttgtaataacaaatggactaccggatggcgttcaaccaaacggactttacaccccaaagcagccagcacaaaggcgtcacgtcccaaaccggcagttgcatcaataactgtcggcagataattacctttgatccctaccgcttttgccacagcttcagctcgaccgcctccaaatttacgacggtgagccattgtgccggtcacaaaatccacataaacagcaccaagtttcggctcatctaatttgcgtaattccaagcgaacctgtccttccacttttgtttgcaccagtgctaaataactattaggatcgtgaatcaaacctttttgttgacaaagtgcggtaaattgcaccgcactttctgtttcacaaattaattggattttttgattaaccatacaccactttccatatgctctgtataagggaattgatcaaacaaggcggctttttcaatacgatgagttttagttaattcttgtaaattttcacataatgtatatggattacaggatatatataaaatccgctcatagttttgtactaattttactgttgccatatcaagtccagatcttgggggatcaacaaaaatggtattacattgataatcttgtaaattaatgccttttaagcgattaaatgcacgcacaccgttcatagcttgcgtaaagtcctctgcggacatacgaataatgtgtaaattatcaattttatttgctgcaatattaaattgagccgcacttacagagggttttgcaatttctgtcgctaatactttgcgaaagttttgtgctagggcaatagagaaattgccgttcccgcagtaaagctcaagtaaatcgccctgactatttttagtacaattaattgcccattccaacattttacaatttaccgttgcattaggttgagtaaagctgttttctacttggcgataaatatactgttgatttttgacaggcaaaatttcatcaacaaaatcttgctgtaaacaaattttttgtttatttgcacgaccaataatttgtacatcaaatccttgttttatcagttgttgtttcaattgagttgctgcctgtagccattcttcgttaagtgttttgtggtataacaaactgacaatgatcttgttgctcaaagtactgagatagtcaatttggaataagcgatgagttaaaatattgtgttgtttaagcaaaggcaataacgccagcatcatttggttaatcaactgactggcaataggaaattgatcgatacgaaaacgttgttttgttttttgatcaaacataatatgatagaaatcatcttgttcatgccaaatacgaaattcggcacgcatacggaaatggcttgtttcggaagcaaatacgtcaagcggtggtgaattaaaaggtgctagaagtgcggtcagcttttgttgtttttctgctaaaagtgcggaatattgttcaataggtaaacgttgcatgatcttcagtattgagctaaaaatgaaaaggtgcgaatttcgcaccccttttacttaatcttaagttattcggcagagaaatcatccggattgtcagcaccaacaacgcctgataatgtgtaaacacgtttactggcagaaatacgagtgcggtatttattccaagttttctcaaaatatgtttctgccgggcgttctccacgacagaaagcaacgaaagctttttcttcttccgtaactggtacacgctcacctaaatctaacgctttaaatgcttgaccatattgctctaacgtttgagattcacgaatggtgtaatcaccatgacgagcaaaacctcgtggataatttttatcatcgaaaaaacgacgtgtaacactaaaactctctgccataatatcctctatcttattttgtaaaaatcggctcgcattaaatcaattttttgttatttttgcaataaacctttaacagtttctacataatccttgataaaaccgtctgttgtacgggataaaccttctgagtttactttatatttaccgttaatataaaattcaggtgttgctcttacgccaagtttttttgctaaggcaatttgtttgtttgtttgagcggtgacggcaaaactattaattcctccgtcaaactgtgccgcagtaataccgtttgcgagaaacacttcacgaatattgtctaaagtaggtgcttttcttttttcaataatcaattcaaatagaggcattttaactttttcttctatgcctaagagaattgctaatgaccaagcacgaacaatatcttcgcccatccaatcaacatgatattgtttgaaagtgacatctttgggcaaatcagctttaatttgttgtggaatttgatatgttttttcaaaattaaaacaatggatacaaccaaaagagaaaaattcaatcacttcaggttgaacggaacgaggctgctctagttcaatatactgttttccttcttgtaatactaaggcttgagttgaatttaaaaagaaaaaagaggctaatgcccatagaaattttttcatgtaatactcctaatcaataatgccacgtgcttttaataaggctgttttaaaatcgtcttcataatcttttttgatgccgggaataggctcatttttatctgtaccatacatttttaggtgataaataataacctcgtcggttaattccgcaatgggcttatcaaaaccggtttcctctgcaattttttgtaaaacttggattaaatgtaaatccggattgttagaccaatagggctgtaaaagttccaacacttcgtttaaacgatgacatttcataaagttttccttattatttaacccaaacagccgacaatcatacttgaaataggtaaagaagaaaatatggcaacaacaattagtgcagtaattttagctggtgggcaagctaaacgaatggctgggttagataaaggattacaactgcttcaaggtaagcctctctatcaacattgcttgcaaaggttaacccatcaagtgagtagtatttctattaatgctaatcgtcatcaagctatttatcaacaaagtagggtagaggtttttggtgatgaattggaggattttcaaggtcctttaagtggaatattgaccgcacttgagcgagctaatacggattttgtgctttttgtgccttgtgatagcccttttttgccgttgaatttatgtgaaaagttgcaaagtgcggtggagaattcgaaaagtttattagcttatgcaaatgatggtgaacgtgaacatcctgcttttagtttattgtccactcaacttaaattaccgttaagagcttatttgcagtccggtcatcgtcaaatgttacaattttttcgtcaacataagggtatttctgtggatttcagcttacaaaaacaggctttcgtgaatataaacacattgcaggatattgaaaaatatcaaaatatttatgcttaattttttgttttaattattaattaccttaatttgatcataaatatatgaaaaatcattttttttactaagcaattagagtagacttcccctccgttgatatattacataggaataaaaaatgttaagcaaacaacaatcattaaaagaactcacatttcgaggaatgttattgggggcgttgatcactgtggtatttacggcttccaatgtatatttgggtttaaaagtagggttgacttttgcctcatcagttcctgcagcggttatctcaatggcagtattaaaatttttcaaggggtctaatattcttgaaaataatatggtacaaactcaagcatcttcagccggaacattgtcttccgttatttttgttatccctgctatgttgatgctgggatattggcaaggtttcccttttgggcaaacattattaatttgtatttccggcggtatgctaggggtaattttcactgtgccgttgcgtaatgtcatggtagtgaaaagtgatttgccttaccctgaaggcgttgccgcagcagaagtattgaaagcgggtaatgatgaaatcggtggaagaggtgtcaaagaacttacaatcggtggtctgattgcagcggtagccgggtttttaactaatggtttacgtgtaattgcggatagtgcaagtctttggttcaaaggtggaaatgcaatttttcaagtgccgatgggtttctcactcgctctgttaggtgcggggtatttagtgggtatgattggcggtttagccattttattaggcatttttgttgcttggggagtagcagttccttactttacttctgtcgctcctatgccagctgatgccgatatgataggttatgctttcagtatttggaaaaataaagtgcgttttattggtgtagggactatcggtattgcggcaatttggactttattggtgttaatgaaaccaatgattcaaggtatgatcgagtcatttagagctttgaaagatccgaatgcaaaaaatactgaccgcacttcccaagacttatctccgacaacgctgattttcaccacgttagtaagcgttgtattaattgtattggctttatatagctttataaatcctgtgggtattgaagccggcacggcgatcattttaattttggtttgtactttacttgctgtcgttatcggtttcttagtagcagcagcgtgcggatatatggcaggtcttgtgggatcatcatcaagcccaatttccggaatcggtattatttctgtggtaacaacttcattagtgttaatgcttgttggttctgctacaggtttattagacacggcggaaggtcagaaatttttgaccgcacttacgctatttaccggttcaatcgtggtttgtattgcggcaatttctaatgataacttacaagatttaaaaaccggtcaattagttgaagcaacaccttggcgtcaacagtttgccttgattatcggtgtgattgtgggggcgttggttattgctcctgtattggaaattctttatcacgcctatggttttgccggtgcaatgcctcgtgaaactatggatccgagccaagcacttttcgcaccgcaagcaaccttaatgatgactatcgcaaacggtattttttctcataatctcgaatggaactatattttctttggtatcggctttggtacggttttaattttcatcgacagcgtattgaaaaaggcgtctaacaaacgtttagcgttaccagcattggcagtaggaatggggatctacttaccgccgtcagtcaatgcaccaatcgttgtcggtgcattgcttgcttggttgattaatcgtcatttagaaaactttgcgaaacgtacaggcaaagatcttgctgatgtgaagaaaaaagcggaacgtttcggcacattatttgcagcgggtttgattgtgggtgaaagtttaatcgggatattactggcatttattgttgcaggttccgttacttccggaggttctgatgcaccgctagcattacatttagaaaactgggagagtctagctcaagtattaggcttaatgatgttcgctacgggtataacaatctttgcattacgtgtactcaaggcgaaacaataatattgcgaaaattaaataggacttgacaaaaaacctccagctttagaaagcggaggttttttctacacaattttgaaacaagaaaactaagtaatattcacttcataacaatacctaacgattaacgcacaccctgtttatctaatctggcgaaatctttacatccttgagcgttgccgttatcacatgcttgaccgtagaatgttttagctgtagaaacatttttttgtgcccctcgtcctttttcatacatcacgccgagatagagttgtgcttctgcaatgccttgttcagcggcttttgtgaaccaatagactgcttgttgatagttttgagcaacgccttgtccgtttgcatacatcacgccgagatagagttgtgcttctgcaatgccttgttcagcggcttttgtgaaccaatagactgcttgttgatagttttgagcaacgccttgtccgtttgcatacatcacgccgagatagagttgtgcttctgcaatgccttgttcagcggcttttgtccaccaatagacggcttgttgagagttttgcgtaacacctagtccgttcgtatacataaagccgagcatagattgtgcttttgcatctccctgttcagcggcttttgtgtaccaatagacggcttgttgagagttgtgtgtaataccctgtccaaacatatacattgtgccgagcacagcttgtgcttttgcatttcctttttcccccagttgtttgagtaagggaaaagcggcagaataattttgttgtttgtaaagttgagtagctcggtcaagtttttcgctattggtttcggcaagtgcagattgggcaacaccgaaagagagcaaggcgataagtagggatttttttaggttcattttatgttccttatttgacgattatttgaattcaatacacaaagtttgtggattgagaaaacattttcttcccgtttcaagaggggtgattggattcaaaatatttaaattagaatcaaataattgagagctgccattagcaatcattttattgacgatttcatccacctctttttgttcattaggattgatggcttttatattgtcgtaaacataaggcgaatctgaggtatctccaaaaaaattcttataaataccaacagtaatttcaatacgatttgacatggttttttcctctgatttgattttatatgtggcgttcgctacctactatcaagtaggtaggatgtagagtatactctacatcctttgacgtcctcccctagctaaagtaaggagattcctaccagctcccacagcaagctgtgggctactctcggagggtttctgctgctgaccgccaatgcgattcacttcacagacgctacgggcacgtcctgccctgattatgccgtcattgagagtctaaagcgacctctgttagcagtaagaagtatatcatatttgtgccttatatccatgccctaaaggacgtggttttatggcacgattagataaaggattgctaaaccctttgctcggtgtcgattggtctattgagtgttatttatacagcagtatattaaaaaacaactccggtttgaaaaccggagttttttatagatattaggcaaaagtatctaaatattgatctgttatttgggagacttatttgactagcccgccacttgcttgtaagtcagcatgatacgaagaacgcacaaaaggtccgcaagcggcatgctcaaatcccattttttcggctttatcacggaaatcatcaaattcctcaggtggaacgtatcgggcaacaggtaagtggtggcgacttggttgcaaatattgacctagagtcaacatggttacaccgttatcccgtaagtcctgcattacctgtaaaatttcttcattggtttctcccaagccaaccataatgcctgatttggtagggatatgtggaaaaatggttttaaattctttgagtaattttaacgaccaattatagtccgcacctggtctgatttcacgatataaacgaggtacattttctaaattatggttaaaaacatcagggggattatcttttaatttttctaatgcttgctcaatgcgtccacgaaaatcaggcaccaaaatttcaattttaatacatggattaagtttgcgaatttctttaacacattcagcaaaatgtcccgcaccacgatccggtaaatcatcacgatccactgatgtaataacgacataacgtaatttcatatcttgaatggtttccgccaatttttttggttcatccggatctgggggtaatggttttccatgggcaacatcgcagaatggacatcggcgtgtacaaattgcacctaaaatcataaatgttgctgtgccgtgattgaagcattcatgtaaatttggacaagacgcttcttcacatactgaatgtaatccatgacgacgcattccgtttttaatactgttaattttcgcagaatttgcaggaagcttgattttcatccattcaggtttttttaataactcctgatttggatcgatatttttaaccggaatgattgacgtttttgcagcatcacgatatttgacaccacgttccattttaaaaggggttgtcattaacagatcctaatttgttaataaattgttacatcattatagcccaataattgcgtaaagtgtgtaactaatttgggtgcaactttatcacattgagcttgttcagtgggtataaaatctgccatttggcacatttctaagcctatatagccacaaggattgatttgtctaaatggcgataaatccatgttgatatttaaggctaaaccatggaaagagcagcctttacgaatacgtaaaccaagagaacaaattttttgttcatttacatatacaccgggggcatcagctttcggataacttttaataccataatcagccagtgtgctaaccactgattgctcaagagcggtaactaattgacgaacattaagttcactgccgtttgctttgtgacgcttaatatcaatcagtacatacataatttgttgtcctaagccatgataggtaatttgccccccacgatcggattgtaccacaggaatatcggttggattgagcaaatgttcaggtttacctgcttgtccttgtgtaaaaacagccggatgttgaactaaccaaatttcatcagctgttagcacatttcgagtatcagtaaattctcgcatttgttgccaaacttgttgataatcttggattccaagttggcgtataataagagtagtatctgtcattttctgtcttaaagtaccatgcgtacaccatcaattttggctagttcagtatagagaatttctacttgttcaatattttccgcaatgatatctacagaaattgaattataagttcctttgctactgatattttgacgagggttataatcacccttagcgtatttttgcgttaccataactacatcatcaattaaatctgctcggtttttaccaacgactttgaaagtaaaagagcaaggaaactccaacaaatcttttaattgtttttgtggaatgtcgttaagttttactgttttgtcagtcataaaatttccttaaagtgaaaatatgccggaaagtgcggtctgatcttattgttgttagttaaacaaaccttttactgttaataccagccagtcccaaagtttgctgaaaaatccgccttcttgaacttcagacataatttttaagtttgcacttgcaatattacgaccatctaattgataaataattttacctacaatttgtccttttgctaacggagctgttaacattttttgattaagctcgtatcttgttttaacatcattctggcgagctttaggtaaagttatataagcatcttccagcaccccaagttgcactttgtttgtattaccgtagtaaactttttcttctacaatagattggtttgcctgtaaagatttgaaggtttcaaagttagcaaagccccattgtaacaattttttactttcaatttcacgacctttgtgagtagcaacgcccataacaactgaaattaatcgcatattgttattatttactgcagaggcaaccaagttataacctgctttatttgtatgccctgttttcataccgtctactttgattgatttatcccaaagtaaaccgttacggttatgttgcttaattttattgaaggtgaattctttttcagcatagattttatattcttcaggcaggtcatgaataatatgacgaccaataatcgccatatctctggcagatgaatattgattatcatcatccaatccatgaacggtcataaagtttgtattttttaaaccaaatttagcaacatatttattcattagttcaataaaattacgctctgaacctgctatatgttccgctattgccacacaggcatcattaccggatacaatcactatgccacgatttaaatcagctactgatacttgttggtttaaatttaaaaacattttagatgaaccgggaaaattttcccccaagcactttcatcaatggttacagtgtcggttaagctaattttaccttgcttgattgcatcgcctacaacataacttgtcatcatttttgttaatgaggcagggtgttgacgctgatccggattaaaggcagcaagaactgcacctgaatggtaatccatgagaatatagctttgtgcacttaattccggtgaagcaatgccatattgaatatcttgggaaagtgcaggtaatgaaattaatcctgacatcagtgcaatttttgtttttttcatcgctttttgtaacattttacgtcctttaaaaattatttctcattgtaagagatggtgataaattagtgtaattggcggatttatttaacctatctttaaaaccttattgctaagatttaatgtttttacgtgttttagccaacgtttttgtacccggtccggaaatttttccataagcatcaacatataatgattctacctttacttttgctatgccggcatgaatcattccaagctcttttgcggcagcttcagataaatcaataattcgtgctttgctaaaaggtcctcggtcattgattcttacgatcactttacgattattgcgtaaattagttacgaccacataagagtttagtggcaaagttttatgtgctgctgtataggcattattattaaaaatttcaccgtttgcagttttacgtccatgaaattttttgtgataaaaacttgccattcctttttgtgaataattttttgccttttcgtagggtagtgttgtatatctaacgcctttgactacgtaagtatagggctttttactcagtttttgatagactagcttagctccttcaatgccatataattttttcgtatccgcctgtattgacagcgaaactaatgccataaaaagtgcggtgcataatttaaatattttgtttgacttcatagtaataagtttaatattgattgtattatctaagataaatatttatttagttcctttgaaaaagttatttttatgtgtatgaatggacatgattaaaccaaatccagccattaaggtaacaaaagaggttcctccatagctcattaaaggtaaaggtactccaactacaggtagaatgccacttaccataccaatattgacaaatacataaacaaagaaaattaatgtcaatgcaccacttaaaattcgtccaaaagaattttgtgcattaacaccgataattaaccctcttgcaacaataaagagatagatgagcattagtattgtaaatcctgtcataccatattcttcacttaatacagcaaaaataaagtctgtatgtggttccggtaggaattcaagttgcgattgtgtaccttgcatccaacctttaccccaaatcccccccgaaccgatggctatttttgattgcataatgtggtagccagcacctaaaggatctttttctgggtctaaaagagttaagacccttgtgcgttggtaatcatgcattaaatagagccatacaattggagtaaaagcagctaagcccacaatagcaattaagatgaaccaccagttgattccggctaaaaatacgacaaaaatcccggatgcactgactaaaattgacgttcctaaatctggctgaatagctactaataaagtcggcactattattaataataaagcaataaaaatttcacttaatttaggtggaagaggacgttttcctaaatatgttgcaaccattaatggtactgataatttaacaatttcagagggttggaaacgaaaaatccctagatctaaccaacgttgtgcccctttacttgttgttccaaaaagatccactaacagtagtaaaattacgccaatgacaaatccataaggtgcaatacgttgataaaaccttggtgaaaattgtgccatcacaaacataacagtaaaaccgagagcaacttgaataattcggttgcggaacattttttcactgcctcctaccgcactataaagtacaagcaatccataggaggaaatggttactaaccctagaaaaagccaaaaatcaatatgcaaacgacgccacaaaatcagccaaatattttttttctccatcaactttttcctttttcatttttcctttttcattttgtaattgtacttgtggcaaacggatatttaaataatagtccataatttttcgaacaacagggcctgccttactgctaccaccaccggcattttccaaaataacaacaacaaccattttgggatcgtcataaggtgcatatccgatgaaccaggcatgatcgtgcaatttattatcaagttcgtttgcattgtaagtttgattttctttcaggctgaaaacttgagctgttcctgattttcctgcaacaggataactgacatcaataaaagatttacgtcctgtaccattcggtgcgtgtattacattatacatgctttgttttatcgtttcccaaaataccgcttgaggttcagtaatatcttcgtaaagacgaggatcttgatagggttgcatttctgacccttcaactgctttcattaagtgcggagtattaaccttgccattattaactaaaactgcagttgctttggcaacttgtaatggggtggctgtccaataaccttgaccaattcctacagaaatagtatcaccctgaacccaaggtcgtttgtagcgtttttgtttccattcccgacttggcataagtgcggcggtttcttcttgaatatcaatacctgttggtacaccaaaaccaaagcgtttcatccactgagataaacggctaatgcccatgtcgtaagcaagttgataaaaataagtatctgaagattctactatagctttattcaaatcggtgtagccgtgccctgattttttccaatctctaaaacgtttggtggtattaggtaaaatccaatatcctgggtcaaatatcgtagtatttgtggtaattaaattttcttgcaagccagcgatagcaacgaaaggttttatcgttgaagccggtggataagcaccttgagtcacacggctatacaaagggcgattaggatctgtcagtaattgcttgtaatccgcacttgaaataccgccaacaaaaagattgttatcatagctcggggtagaaaccattgctaaaataccgctatctttaggatctaatacgacaactgctgcacgaagattgcccaataaatttgcgatataacgttgtaattctaaatcaatcgttaagtgaatactttttccggcaatagcaggctgttcccttagtttgcgaataaccttacctctattattcacttcaacttcttcaaatcctactttgccatgtaagtcatcttcatagtaacgttcaataccgagcttgccaatatcatgagtgccggcgtagttggcgtatttttcatttttctttaaacgctctacatctttttcattgattttagcgacataacctagaatatgagtcaacggctcaccatacaaatagtggcgtttaaagtaaggcctaatatcgaggctgggatagtgatattggtttactgcaaagcgtgcgatttgttcttcgcttaaatctcctttaaggagaattggcatatatcgagatgagcgacgacgttcctttttaaagttctcaatatcatcatcatttaaaccaacgatatagcgtaactcttcaaaagtgcggtttaaatcctcaactttttccggcacaatatataagccgagaaaggtaatattttccgctaataatttgccgtagcggtcgtaaattagccctcgagtcggtggcaaaggaagtaatttaattcgatttccgttagatcttgtctggtaagtttcgtaattgacaatttgtaaataatacaaattggtaaataaaagtgctgataaacccaatacacctagaaaggcgataagagcacgacgagcaaaaaggtttctctccgcctttttatctcggatcggtgtttgtagaggttgagagagtaatttttttaaattcataaaatattaaccgcacttattctcggtgataaggatgatttgtgcttaacgaccaagcacggtataaactctcagccacaacgatacgtaccaagggatgaggtaaagttaaaggcgaaagagaccaactttgttctgtcgcagctttgcattcaggtgataatccttccggaccaccaattaagagtgcaacatttcgaccgtcatgtttccatgcttctaattgctgtgctaattgctcagttgtccaaggtttaccgggaatatctaaggtaataatacgacttttctgacaagcggataacatagctttaccttcttgttcgagaatacgtttaatatccgcattttttccacgttttcctgccgggatttctattagctcaaaaggcatatctttgggaaaacgacgttgatactcctcgaagccttttgtgacccaatcaggcattttagtgccaacggcaattaattgaattttcatagattaataagtgcggtcattatccccaaagtttttccagctgatacatttcacgactgtcagcctgcataatgtgtacaatggcttgaccaaaatctatcgcaatccaatctgcggtagatttgccctcttcgccaaaagtatcaatgccggcttgcttactttcatcaattaatttctgtgccaaagagattacatggcgacttgacgttcctgtacataaaatcatgtgatcggtaatagaagatttacctctaacatcaagggctaaaatatctgtgccttttaaatcatctaatttactcactagaaaatcgactaagttcattttttctcttctcaattgcttatggttatttgcttaaaagtgtgtaatgttagcatgatttgggggagctaggaatatcgtttgatagtgtaattatatacaaagaacgctcttttacttatataaaaaatttttctgtttataaatgatttctcggacagcgattggaagagatgagcgtttatttattatttaggttcacaaaaatcttttatgtcagtaatgccacatacattgaaagcacatctgtattggttttcactaatgttctttataaagaaactgcacctattaatggtacagttgtgttttgtcaaaaatacaaagtgataatgtgtaattctaaatttttctaaatattaactacacgcatcgcgatatatttactataacctaaggcacataaaaaaaggcttgcttgaagtaagataatacaaggtcctgtggcgacgttgaaatgaaaactgagcaatacgccaaaaataccactgaatactgctgtgcaaacggcaattagcatcatataatcaaagcgtttagctaaaatatagcctgttatcccaggtgtaatgagcattgccaccactaaaataacgccaacaacttgcattgcactgatgatgactaacgctaggattaccagtaaaccatagtgtaaaaatttggtgttaagtcctgcaactcgtgtgtgacttggatcaaaacagtaaagcaacaagtctttgcgttttaaggcaatcaggataaatgccagtagtgcaatgccaatactttgccaaaattcttgcttaatgatacctagaatatttccgaacaaaatgtgcattagatgttgatcggtttccactttggaaaacagcaccaaaccgaaagcaaacattcctgaaaaaacaattcccatcactgtgtcttctttgattcggctgttatctctcaaataacctacggaaactgcacaaaagatgcctgcccaaaatgccccaatcgcaatcggaattgctaatacataggcaagaataattcccggcaatacagcgtgagaaatggcatcacccattagtgaccagcctttaagtactaaataacacgataaaatcgcacatactgccccaatgataggtgcgatgataatagcttgttgcataaatggatacaccaagggctcggtaaaccacgctacaatcgtattaaacatttggcttctcctgatttgcaagatttggtgaggaagtcactgctttttgtgtacttcgcttacgtggaataagaccatatttgggagcaaaaaagaaagcaagcaagaagatgaacgtttgcaatgatacaataaagccaccagttgcactgtctgcgaaataactcaaatatgctcctagtgagctagtagtaccaccgagtaaaatcgaaataatcaacaggcgatcgaatcgatcggtgagcaaatatgctgttgctccaggtgtaatcaccatcgcaattaccaaaatagcccctactccttgtaaggcggttacaatgcatgcacttaacaaggtaaagaataaaattttgaattttaaaggcgatagccctaccgctttggcttgaatttcatcaaagaacacaagcattaggtctttccaaaagagtagcaacaatacaaatgatataccgagaataatagcgacttggatcatatcttcatcggcaatacctaaaatattgcccaaaacaatagattgtacgttcacggaagtgggattaattgaaataatcaacaatccgagagcgaagaaagaggtgaaaataaaaccgattactgcatcctctttgagtttagtcacgtatttcactgctaaaatggcaatagtggcaagtagcccagagaaaaaagccccgacggcataaggtaatgccaaggcataggcaatagcaacgcctgggacaacggcgtgggataacgcatcaccgatcagtgaccaacctttcagcattaaataagcggaaagaaaagcacaaaccgctccaatggcaccactgaccacaatcgccttaaacataaaatcataagaaaacggctcaagtaatagctctaacatcgcattactccgcatcttgaataaaatgttgataacgtaaaacgccaccaaacacacgagttaaattttcttgagcaaaagtgctttcgattgatccagcagcgagtagtgtacggttgatcatcaccgcttgatcgcaaaaacttggcacggtgctaagattatgcgttgaaacgagaatgagatgaccttcctgacgaagctgtttgagtaacgcaatgatggcattttctgtgccaacatctacacctgtgaaaggttcatctaataaaatgatttggctttcttgtgctaatgcacgagcaagaaatactcgttttttttgccctccagaaagctcgccgatttgtcgatctcgcaaatgagcaatattgactcgctccattgcgtctaaaacttttttcttgtcttgtgctttaggcatacgaaagaaattcatataaccataacgccccatcattacaacgtcataaacagaaacggggaactgccaatccacttcttcactttgcggtacataggcaattaagttttgttttaatgcccgattagcgggcatgttacaaatttcaattgaaccttgaggcttcactaagcccataatgcttttgaataaagtcgattttccacttccgttaataccgagcaatgcacaaatcgtaccaccttcaaggtggaaactcacatcgtgcaacgccgtatgaccattactataacgaaccgtaatatctctgacagaaagagaactgatgtgagttttcattcaattaccttattttttgaaaccattcacaatggtcgaaacagttacatttaataagtcgatgtaagttggtactttaccatcttttgtagaaagtgaatctacataaagtacaccaccgtattttgcattggtttctttagccacttgttttgctggcttatcagaaatggtgctttcgctgaacacaacagggattttgtgttcacgtacttttttgattacatttttgatttgttttggtgtgccttgttcttcagcattgattggccataaataaagctctttaaaaccgtagtcgtgagctaaatagctgaatgcaccttcactagttactaaccaacgttgtgaagctggtactttttctaactcagcacgtaatggtgcgtctaaagcaacgattttatctgcataggcttttgcattagcattgtaagtgtctgcatttttaggatcgtatttcactaaagcttcacgaatgttttcgatgtataccaaagcatttttggttgacatccaagcatgtggattcggcatacctttgtatggaccttcgtagatagaaattggatcaatccctttagttacaacaacagctggtttatctttcacttgggtaaagaaacgctcgaaccaacgctctaaattcattccattccaaagcaccaaatcagcagattgtgcttttacgatgtcttgtggagttggttcataatcatgaatttctgcacccggctcagtgatcgactcaacaacagcagcatcaccagcaacattctgagcgatatcttgaataacggtaaaagtagtaactactttaaattttgcgtaacttggtaaactgaatacagaacctaagattacacccataacaataagtaaacgtgacataatttctccttcgaattaatattagaaacaaatttgcatttcaagcaaactcggtcttgcatagtactgcaaaaataacttattgtaaatagcaataattatcaattaaagacattttattggtttgggtaaaccagctaattttgaagcttgttttgcgggaccttctgggaataaacgttgtatgtaacgactattgcctttatctgcacctagcttttgtcccaatgctttgactaacattctcattgctggtgaggttttatactcttgataaaaatcccttacaaagttaataatttcccagtgggcttcggttaattcgatattttctgattttgcaatggctatcgcgacatctttattccactgattcatatctaatagatagccctcaacatcagtttcaatttgaacttggttaacacttaacatatgttactatttttgtccttttgatatataaaaagtaaaaagcccctattcaaggggcataaaacaagtttaatcaattattcatcacggttgaaaatacctagtaaattgagcaagctgacaaaaagattgtaaagtgaaacatacaaactaactgtagctctaatataattagtttctcccccatgaatgatattgctggtttcatataaaatagccatagttgagaaaacgataaataacgaactaaatacgatatgaaagccactcatattaaagaagaaacttgctatcatgcctataaccaatacgataaagagagctagcatcatgccggataagaatgacatatcttttttcgttgttagcacataggccgagcatgtaaaaaatacacttgcagttccggctagagcaagaacaaccaaatcacctaatcctgagccaacataatagcttaaaataggacctaaagaatagcctaataatcctgttaatgcgaatgtagataaaagtccccaagcactgtttgctaacatattattgaggaataataatccataaaaacctaccaacatgacaccgaaatgaagtggagggagatttaattgcattgcactgaaggcgacaacagcagaaaaagccaatgtcaatgctaataaaaagtaggtgttacgtaaaaccttatttgttgccagtaccgattcttctttagtatcaacaataaaacgagattgcataaaagctcctaggttgtagttgtaaataaaaagtgaaaagctatttataagttaatggttagcaactttaatgtcaacatgaatatttttcagaaaagagtaacattgaagtaaaattaagtaaaaatggataaattatcaactcttaaaccataactgttatttttttagtttacttctatttctatctatattatattacgcctcgtcaagacggaggaatggtcgagtggttgaaggcaccggtcttgaaaaccggcgagggtttacgccctccgtgagttcgaatctcacttcctccgccatmaagttttactaagtcgtaagttatgcctytgaaatcagtaacttacgrcttttttatatcaggttaattgtcgtaataacttgcttaaaaatcaccgcacttattggtctgatagtttccgtagcaaacgatccatggctcgatagcttaatgcttcagctaagtggttttgtttgatatcagaatctccgtttaaatcggcgatagtgcgtgcaacttttaaaattcgatgataagcacgaacagataaaccgagtctggttaaagtattttctaaaaatagtgcatcttgctcagtcaacttgcaatctcgctcaatttctttaccggttaaataagcattgacttttccggctctagctagctgaatttctctgacccttaatactttttctttaacttgtgctgttgtttcacctcgatcttcggtattttgcaaagcaccttgtggaagtaaaggcacttcaatggaaagatcaaagcgatctaaaaaaggaccggaaagtctgttcaaataacgcaacacttgttgtggtgaagtgcggttgtgtataccggtataatgtcccgttggacttggattcatcgctgccactaattgaaaacgtgccggaaactgaatttttgcattcgcacgtgaaataattatttctccgctttctaaaggctggcgtaaagcatccagcactctccgttcaaattcgggtaattcgtctaaaaataatacaccgttatgagccaaagaaatttctcccggtttcggaattgttcctcctccaaccaatgctggtgatgaggcactatgatgaggtgcacggaaaggacgttgtttccaattttgaaaatttaattcgttttgtaccaaacttgttacagaggcggtttctattgcctcttgatctgtcatatccggtagcaagccagttagacggcttgctaacatggttttacctgtgccgggcggtccgagaaacaacaaattatgttgtccggcagctgcaatcattaaggctcgtttagcatgttgttgaccaataatatccgtcagatctttattagattgaggtgaaaaatccaccgcactttgcatacataacgttgtggatgaaggtagcgaactgtcgtcattcaggaattgtacgacctccaataagttccgtgcaaaaaatgtttcgtgttgtgaaactaaagaggcttcattagcattttgttgtgcgacaataagttgacgcttagatttttgccccgctaaaatagcagggatcacaccgtgtacgcctcttaactcacctgtgagagccaactctgcaacaaattcaaattgttgtaacttttttgcattaatctgttccgaggccgctaagatgccgagtgcaataggtaaatcaaaacgccctccctcttttggcaaatctgccggagcaagattaactgtaatgcgttttgccgggtatttaaattgagcattgagtaatgcactacgtactcgtccttgtgcctcagttactgttttctccggcaatccaacgagggtaaaagcaggttttccattactcaagtgaacttcaattgtcaccaaaggtgcttgtacgcccattgatgctcgactgtaaacaactgctaatgacataatttctcccaaatttttgagctaaaatataaaaaaagcagcgagtaaactgtacttactcactgcttttttgcgatccggatcgtaaaagtaaaaaagttttagctaaaaagcggagaaaaccactgatctaatttttcggataagcgttcgataccgattttattttgtgcggaaaaggcttcaacttgtacatcaccttggaaaggtaaaatcgcttctcgaaccatttttacttgcttacttctcgcactttgactcaatttatccgcttttgtgagcaataataaaaccggtaaatctgcggaaaccgcccattcaatcatctgttgatcaagatcttttagaggatgacgaatgtccattaaaataaccaaaccacctaaacattcccttttttgcagatactcacctaaagatttttgccactgaagtttcatttgttcgggaacagcggcatagccatatcccggcagatctaccagcttacaattgggttctacttgaaataaattgattaactgagtacgtcccggtgtttttgaagttcttgctaaatttttttgctgggtcaacgcattaagtgcggtagattttcctgcattagatcgtcctgcaaaagcaatctcaatcccactatcctcaggcaatacctggatattcggtgcactcattaaaaaatgggttttatgataatttaattttatgtttgtcattttattttcgcttaggtcgttgccaattggaaatatggcgttgtggaatacgagtaataaccaactcattttcttgtacatctttggtgatggttgttcctgcaccaatcgttgcaccgcttgcaattgttaatggtgcaactagctgactatcggaaccgacaaaaacgttatcgccaatcaatgtcttaaatttattggcaccgtcataattacaagtaataacaccggcaccgatattacaatgatgtccaacctcagcatcgccaatataagtgagatgatttactttagatcctttgccaatttgtgcttttttgatctcaacgaaattacccacatgagtatcttcattcaattttgcaccgggacgtaatcttgagaatggtccaattttggcattattacccacaatggcatcttcaatcacagaataaggttttatttccacattatctgcaatcgtacaatttttcagtacacaacctgccccaataaacacattattgcctaatcgtaccgttccttcgataattacatttatatcaatttccacatctttaccatgagttaattcaccacgcaaatcaaaacgtgcaggatcagcgaaagtaacacctgcaagtaacaatttttctacttgcttacgttgataatgacgttctaaattagctaattgtaaacggttatttactccctctacttccataagatctttagcttgtaccgctacaactttgaagccatcttgattggcaagttctattacatctgtcatgtaatattcaccttgtgcattattattatctaaacgagctagccatttacggaaacttgcaccgtccgataccataacgcctgtattcacttccgtaatttttagctgctcaggattagcgtctttctgttcaacaattgccgttactgtaccgttttctcgaatcactcgcccataacctgtaggattgtctaaattaacggtcaaaagtgcgataccattttccggtttttgtgaaattaaacactcaagggtttccttgctaattaaaggtacatcaccatataacatcacaatattttcgtcatcttggaaaaaaggcactgcttgttgcattgcatgccctgtacctaattgttcagcttggaatacccagtttacaggttcatcaaccaactgttgttttaacaaatcagctccatgtccataaattaaatgaatttgtgccgcacttaattttttggcagtatcaatcacatgtttaaccatcggtttacctgcaattttgtgcaatactttaggtaaatccgaatacatgcgagttcctttaccggcggcaagaataacaacgcttaatttgttcatgataaattttctctttgtcataataatcgatgtattttagcgtaaaacacatgaaaaaataatataatgttatgatgtttagcaaacatacgttcttcttttatgcaaaaaaataatcactattatattggaattatgtccggtacaagtttagacggtgttgatatagccttaatggattttaatcaaagaccgcccaaactgcttgcaagttattgtttctctatgccggaaaatttacgccaaaaacttaccgcacttttatcatccggcacaatcggtttgcagcaattaggcgagttggatcatcaactgggattactttacgcaaactcggtacaacgtttcttagcacaaaatcaaatgaccgctgatagtattcaagccatagggtgtcatggacaaacgatttggcattcaccccaaggtcaatatcctttcactatgcaaattggcgatgctaacctgattagtgtactgacaggaattacgactatcgctgattttcgtcgcaaagatatggctcatggtggacaaggtgcacctttgtcccctgcatttcatcaagccttatttgcacaacccgatcgcattacggtagtgttaaatattggcggtatcagtaatatttcttgtttaattccggaacaagaagttattggttatgataccggtgtaggtaatgctttgatggatagttggattgaacaacatttaggggtgcctttcgaccaagacggtgaatgggcaaagagcggtagtgttcaccaagatttgctaaaagatttattggacgaacctttttttcaacaacttccccctaaaagtactggacgggaattatttaatttggcgtggttgaacaaaaaactgaaaaaacataccgcactttctgcacaagatgtacaggcaacgttgctggaatttacggtacaatgcacggtgcaagagctggttaaactcgctaatccgaaccatttgccttgtttgttgttggtttgtggcggtggtgcaaaaaacagacaactaatggctcgtttacaagcctgtttaccgcaatggcacgtagcaacaactacagagcatggtttatcgattgattatgttgaagccgccgcttttgcttggttagcgtatcagcgtataaatcatttaccctctaatttaccaagtgtaaccggtgctaaaagtgcggtcagtcttggcgttatttatccgaaataatcatgaataaacaaaatttatctaatctgctcgctcaattagttaccgagcaacctaatcaacgctcagtaaatttggatcaaatgtctgcacttgaaattgtacaattgatgaataaagaagatcagcaagttccgctcgtcatagcaaaagcacttccggaaattgccatagtagtggaaaaaatcgttgctgcttttcgtcaaggcggacgcttagtgtatcttggagcggggacaagtgggcgtttaggcgttttagatgcctctgaatgtcccccaacctttggtgttaatcatgaaatggtaaaaggcattattgccggaggagaacaggctattcgttatcctgtggaaggtgctgaggataatcaacaagcggcaatagtagatctgcaagcaatccaattatgttcaaaagatattttagtgggtattgctgcgagcggtcgtacaccttatgtcatcagtggattaaaatatgctaaaaagatagggggatttaccgttgcaatagcgagtaatccgcaaagtgctatggcaaaaattgccgatattggcatcgaaactattgtcggacctgagattttaaccggttcaagtcgcctgaaatccggtacggcacaaaaattggtgctgaatatgctaaccactgcgagtatggttttacttgggaaatgttatcaaaaccttatggttgatgtacaagcaagcaatgaaaaactcgttgatcgagcgacaagaattattatgcaagcaaccggttgtgaacgagcgaaagcagagcaaacgctaacacaagcagataataatgcaaaactggctatcttaatgattttaatggatttagataagcaaagtgcggtggatttattagcgaaaaatcaagataaattacgccaaacgttagactgatttttcaccactacttttctactaaaaaggctgtcagtgcatttgagagatgagatagtttgtaaaaaataggcggagaagataaaataaagcggttcgaaactgtagattaaatctaactagttaatattgttcataaatattaatattcagtttataaacaaacattcggacatgaattgcaagctggatatgtatagtttgcaactgaaatatgatctcaaggaggttaaatgtctttattaaatatcattaaatcgtttttctcatctaaaaaggagcaagccatgccgaatattctcgtcatttcaggtcattcaaatttacagcaatccactgccaacagtgctattttaggtgaattggcaaataaccttccaaatgcagaaattcgtaaattagatgagctttatcccgatttcaatatcaatattgaagctgaacaagcggcattattaaaagccgatattatcatttggcaatttccggtgaattggtaccatttcccggcgattatgcaaaaatggttatctgatgtgttcacttatggttttgcttatggttctgagcaaaaattaactggtaaaaaattgtatatttcttgtactacggcaagtccagaagaagcctatcaacacgatggtgcacaaaaacacaccattgaagaatttagttatgcttatcagcaaactgccgcactttgtggtttagaattttgcggtattattcattctggcaatatgctttatattccgggtatgaatacagaggaagataaagaaaatgtaattgcaaaagcaaaacaacatgctgaacgtctagtaagtgcggttaaataacgcatcatgttaatagacaaaagggacataatgttttatgtcccttccttgagtcaaaataacgataacacttcatcatcatatcttttttaaaatctcaattttttctgtatttttttgaaaatctatatcgtataatgctcagtcggtttaacgataacattaaactatgtaaacattacaaacattattttttctaaataaggggtctcttatgagatacaaattatctttagtacttttatcaatgctgcccgcactttcccatgcgggggggggggggtaatttcaacttttacggcaaagcgggaattgatttaacctctcgatttgaaacgatgaaaataacggaaaatcacgatagtgatagaggttttaaattatcaattccggcaagttcaagacaaaacactttctcacctagtatcttctttgaaacgacttacaatattttaccgcaaacggaaattggtctcggactaggctatatcaaacgaaaaggctttgaccatattgcaatttggcctgtcgagggtagttctttatataacccccgaggacagtttcatctgaaagaaacctatagagtaaatcgttatgcttccctaccaatttattttattttgaaacaaaattatgccttaaatgcaaatacaaaattttatctaaagggcgatttagggtattcaattaataaaattcgtaaaacagtatatactctctatgaggatttatccttgggtagtagcacaggttataaaaaagacagagattttattagtaataataaatctagaagcggtctttacttaggtttaggtttggggattgaatataaatctttcttagtagacattggatattatcatactcattcaaaaatcacttataaagaacaaggaagttacgtatcaacaccctataacaacgatgcaatacgcttaacgcttggctttaaattctaaaaaataaaaaattaacggtcataaaataaatgttttatgaccgttaaacatattcgttaataatgtaatgctaaaaaaacatcaattattttctttaagtctaaattgttgattatggtgttgcacaaatgagtagatgaaatacaatactgtcgctgcaccgaaacagtaataaccgatccacactgccggcaacacgtcttttgccatgaaaatatacagagaaattgaaataaatgtgatgactaaagaaacagcttttgcataagcccaaggttgaatatccacttgcttagtgtattcttcgttgtatggtgtttccattggcatgatgcgaccgataattagcattactactacattcacaacaaataagatagcgattaagtggaaaaaatggatctcaactttaatcacaaatttacataggatataagctaccataccaaatactaaaccgaatttagccgcaatcgcagggacacgttttgtcagtaaaccaaccaccacaacactcaaaattggggcattaaaaataccttgtaattcttggattaagaagaataaaccatccggtgcattggcaactaatggtgcaacaatcattgccataattgctaaacctgtaccgacccatttacccacgctaactaatttcatatcgcttgcatgagggttaatttgtgttttatatacattgcgggaaaataaagttaccgatgagtttaacgcactattaaaggtggataaaactgccccaacaacaactgccgcaaagaagccgactaacgcatctggtaagactaaatgaactaaattaggataagcctgatctggaatatctaatttaccttggtaaatatgataagcaatgataccgggtaaaatgattaataaaggtcccagtagttttaaaaatgcacataaaagaacacctttttgtccctcttttaaacttttcgcacctaacgcacgctgaataatggattggtttgtacaccaaaagaataaattagaaataatcattcctgtgaataatgttgagaaaggaacaacagaattatcgtcaccaatagaattaaatttatcagggtttgtttcgtaaatggtttttaaaccatgccaagcattaccatctcccacataagctaaacctaaaacagccactaaaattccaccgaccaataacccgataccattaatagtatcagatacagcaaccgctttgagtccaccgaaaattgcatagactgatccgagtattccgattccccataccataatccaaattgccgtagtcttatcaatgttgaagacggtagagacatcaaagagactttctaatgcaagtgcacctgtataaagcacgatcggcaacaatgaaataacatagcaaccgaggaacaataaagaggtgattaataatgttcctttgtcaaaacgtttttctaaaaattccggaatagttgcaataccaagttttaaatacttaggtaaaaagtaaagtgcaaacattgcaattgtaattgccgctaaaacttcccatgccattacgataaaaccttcacgataagccaaaccgtttagacccactaaatgctcggtagaaaggttagttaataacatagatcctgcaataaacgttgctgtcaacgaccgcccggctaaatagtagccttcagagttgctaagatcgtcttttctggtgtaccaccaagcaagcacagcaacaagggctgtaaatcctataaatgagataagagatagcatagaaattccttatatgaatgagtgtttctatcattgttgtaaacaacacatcgataaggtcgaatggcgaccttgtttgaaatatatatttcaaaaattattaaatcaaatattttttttcattttgttacagagatcaaactttttagtgaaaaactatcagaaaataaccaagaaaattttatttttaagacttgtaaacccaatatgacattttggtctatatctcaagaaacaaaaatttaaattaaaaacaccgcactttttacattgcataacaccgttactaacaggtaaactagacaaggttaaactagggatgaatatgaaattactaagtaaatattttgtcagatcaatactgaacacgagcatattttgcatatacctagcaagttcgttttcttttgctgaacatcttgttgatttaaaagttgttggtgtaactggtgtacaaaaaacgactaatgtagacgcttatataaataccattgatgaagaagagcgtgatggatctgaacgttatcaacaattagttcgaaccgcaattgataaagcattacgtgcttatggttattacagtagcacagtgaatttcactttacagccggcgaaatcatctaataaacccgtgcttgttgcaaatgtggacatgggaaggccaagtattattcaacgtgccgatgttactattcttggtgaagcaaaagatgatgaggtttttcaagatttacttcgtcgtactgcccaaaaaggcgaacacgtaagccatcctgtttatgaagactataaaagccggttgcaaaagcaattactcgctcgtgggtattttgatgcaaagtttgaggtttctcgttttgaaatcaaaccatccacttatcaaggttggtggaaaatggttttaaacagtggcaccagatacaaattcggacaattcaattttaagcatagtcaaattcgtgaagattacttacgcaatatgatgccaatcaaaacaggcgataaatatttaattaatgatctctcatcacttaccaacgactatacatcatcaaattggtttagatcggttttattagaaccgaaagtcgatgaaaaacgcaaggtggttgatattaatgtattgctttatcctcgcaagaaaaatgcaatagatgtagggattgggtattcgtctgatgtaggcactcgattcaagctcagttggattaagccttggattaataatcgtggacatagtttcaattccaatttatatatatcagccccaaaacaaactcttgaggcgaattataaaattcccttactgaaaaatccgcaaagatattattatgaactgtctggtggttttgaaaaggaaaatactaaagatactcaaactatagcagcaagttttgctgcattacgctactggaatagagtgaccggttggcaacattcttttgggttacgtgtacgttatgactcatttacccaagccaatgtttcagatagaacattatttatttatccaacaatatcggcgaatagaacacgcttaagaggtgagttatttcctacttggggagactcacaacgcatcacggtagattttggaagcaaacgttggaagtctgatgtaaacttctttcgaataaaggcctcaacagtttggatcagaacgtttaaagaaaatcatcgtttcttgacacgtggcgaaataggttggttacacaccaaagatattaataaaataccgcccgcacttcgcttttttgcaggcggggagcgtagtgtgcgtggatacggttacaaaaaaatttctccaacatcttctgatggaaaaccaataggtgcaccatatctattaactgttaatactgaataccaatatcaagcacttgaagattggtggctggcagcctttgctgatacggggttggctgctaataaatttaacgttaaagaactacgttatggtgccggttttggtgtgcgttgggtatcaccggtgggagcaataaaacttgatatagctacaccgattcgagatagagagaagaataaaaatatccaattttatattggattaggttcagaattataaggtcgtaaaaatgacacaaataccaaatgaaaatacaacaacagagcgacaggaaactcgctcggttaagccaaaacgtaaggtattacgctggattttatgcacaataagtgcggtcattttattacttattttatttttagtaaccgcactggctacaaatagcggacaacgcttgttcattcagcttgctgatcatttcatagataatctgcatattgctcaaattgatggtgggttgcaagacggtttacaattaaaacaaattgcttttcacactcaaggtattaaagctgatattgaacaagcaaatataaaactggacttacattgtctattaagtggcaagatttgcttaaaagatctcactttaaatcagcctaaaattcagattgatactgctcaactgccaaagtcggaaactaaaacgtcacaaccaatacaacaaatcaagctacctgttgaagtggacatcaatggtattgagatcaaccagctggatctcacaatagaccaacagcaagttaaattagcaaaatttcggaccgcacttactttaaacaatgagcaaggtttaactttactgcccacagaaattaatggtttaacgatagttcaccgacatctcacagaaaaaacaacgaagaagaaaaagagtgaaaaaactgtaagatcctctgttgattgggaaaaacttacacaacagttaaatcaaccgttattgcctgatatgcccgaaattgagctaccttttgatctacatattcaaggtattcaaggaaaaaattggctatatcaacaaattggcaattcaaatataccgcaaagtgatttacaccaaattgaaatatcaactatttatttacacgcagacagtatagataattctattcaattacaaacgtttcaacttgaaagtaatttaggtcagctacgaggtgaggggacattgcaactcaagcaagaatttccgatagaactacaagttcaagcaacgctcaatgaacttaaacatgatggaaaattgcttttgcctcacagtaacatcaatcttacattaagtggaaatcttaaaaaacaaaccgcacttttcctgcaaactcagggaacgtttgagtcgatattacagggtaaaattgagctttattcacaaaaaacaccgtttgacattgaattaaaagtaataaacggacaatatccatttgagaaaaactctacagaaccattgaaaattcaggacatgttttttactgcaaaaggagatttgctcaattatcaagccacattacaaggcaagctcattggtatgggaatgcctgaaaccgatgtggatttagtactacaaggcggattgacacaatttaccttacaacaacttcgagttaatgcgttaaatatgaaggcgaatgcaaacgccaatgtgagctggaaagataaacttaagttgaaaagtaatgttgagctaaaaggtcataatgttcggctaaataatatgcgaattaacaaaattgatttattggctaacattagtttacaagatatagtgcaaggacaagtcgatcttgatattgatggtttcagtttaaataatattaaattgaacagcactaaattacaaattaagggaacggaacaacaacactatttaatccttaaatcaaagggcgagccggcttcagcaaccttaaatttacaagggaaatttgaccgcactttacaacaatggcaaggtattttaagtcaagtgaatattcattctttaattggcaatttgaccaatagtgaaaatattttgttgtcttatgataataaaaagacaattgcacaagtttctgcccattgctggagatcatcggatattcatctctgttttccacaagagttcattgtaggaaaaaccggagaaattccgtttgattttaaaacaattaatttagcgttagtgaataaattgatctcacaagagattttcaaaggacatttatccggtcaaggaaaattcgcatggtttacggagagttctccttatttgacgctacaacttaaaggcgataatctcaatgtggcaaaaaaattagattatcgtacttttcgtttagctatcccaactttaaatataactacagagttacaaaacaataacttaaccctaaattctaattttaatattcaaaaccgaggagacgttaatatggaattaaaattagctgatttaaccaatcagaaaaggttaagtggtcatttaaaaattagcgatatgaatttaaatatagttaatcagttaatcgctagcagtgagaaagtagatggtcaagtcaatgcaaagttgagttttgcaggtgatttaagtaatcctcttttgaatggtgaatttgctgtgagtcaagttcgagctaagttgaaatcagttccttttggtataacaaatggaaatattacactgagcttttatggtgatcgttcaattctaaaaggaaatattcaaactcacgaaagtcatttaaatgttgaaggtcaagcaaattggcgtaatatcgacgattggcaagcaggtttacatattaatgcagataaatttaaggtagatattccttccatagctaaattacaggtatcgccaaatattgaaattcatgcaacacctaaactattagcgttaagtggtaatgttgatattccatgggcaaggatcgaaattgaacgtttacctgacaatatagttgctcccagtaaggatgaagtgattttagatggtccccaaaaaactaaagtagttaaattgatgaaaggagaaattgagacaactacaaagagcggtatacaaattcactctgacttaaaaatcaagctcggcgatcatgtgcgtttagaggcatatggtctgaaaaccgaattaaatggcttgctttcagtaaaacaagaaaaaggcaaccttggcttatttggacaaattaatttacacaatggtcattatgaatcttttggacaagatcttttaattcgtaaagggattattagcttttccggtttaccttctcaacctatgttaaatatagaagcaatacgaaatccgacatcaatggaaaatacgaatatgacagtaggtgcaaaaatagttggtattgccgatagtcctgaaatcactatattttccgagccaagtacctctcaagatcaagcactctcttatcttcttaccggacgatctttagaaaatagcggaaataatggttccggtggctcacttggtgcggcattattaggaatagggttagctaagagtggaaaattagtcggtggtattggtaaagtatttggtattcaaaatttgaacttggatacttctggtgttggcgacagttcaaaagttgtcgtaagcggtaatattacccctacattacagataaaatatggtattggtttattcgatggattggctgaattgaccctacgttatcgcctattacctaaactttatttacaatccgtttccggtataaaccaagcggtcgatctactttatcaatttgaattttaacgatgaataacgaaaatttattacaaaaagtaaccgcacttgtacaacaccgcggtgaagcgaaagaaattgccgctattgatttaggctccaatagctttcatatggtgattgcccgaattattaacggctctattcaagttttatctcgtttaaaacaaaaagtacaattggcggaagggttagatgaaaataacatgttaagccaagccgctatcaccagaggcgtaaactgtcttgctctttttgccgaacgcttacaaggatttgatcctcaaaatatcaatgtagtcggtacttatacattacgaagtgcggtcaataagatagaatttttacaacaggcggcagaggttttcccctatccgattaatatcattagtggggaaactgaggcaaaaacgatttattccggtgtttctcatacccaacctgagatcggtcggaaattcgtgattgatattggcggcggttcaacggaaatgattattggcgatgattttatccctttaattgccaatagtcgcaatatgggatgtgtcagttttgccaagaaattttttccatgtggcaaaatatcaagggataactttcaacgagctaaaaaaacggcaaaacaatgtattgaagatcttgctaaaccttatcttgacttaaattgggattgtgttttaggttcttccggtaccatcaaaaccgttcatcaagttattagtaccaactataatcaacatgcaattatcacattatcgcacttaaacaagttgataacacaagtattgaaagctcaccatttcaataaattacatatcaatggactcaatgaagatcgtgtagatgtatttgttcccggtcttgctattttgaccgcactttttgaaacctttgctatcaaagaaatgcgttattcagacggagcattgcgtgaggggattatttatagcttggaaaaggatttccaagtcaaaaatattcgccaacgtaccgcacttggtattatgcaacaatttaatgtggatctcgcacaagcggagcgaacctatcaaagcaccttattgctcagtgaacaatatcaaagttggcaagctgttgaattaaaaactgaaatgcaagatattctgttatgggcggcaaggttacatgaagtgggggtcgtgattaaccataaaaatttacaaaaacattccgcttacattctacaaaatatggaattgcccggctttgataaagaacagcaacgcttacttactacaataatccatcaccaatttaatcatttcaaaatgcctgacattggaaaatttgcacgctatccgagggctgatgtaatcgcacttgttcgtttattacgtttggctattttactcaataaatctcgccaagcgacatcgaaaacaaataacattaccctaaaaaccgaccgcactctaaaaaaatggtcattatattttgatgcagaatatcttgagcataaccctttagtcaaaaatgaattgatggaagaacagaaacgcttgtcagaatttaacttagcactggacttttattcttaaaaaacgttatatagtagaacgtgcttgtttcatatcagttattgagtactacgacaagatagactaatcaagcaatgaagacgggcagttttagcatgattagcgatgtgtttaagaatgcaagaaacagtgataaaaatttaaaaataatattattttacttggagagattatgcctaaactacgttcagcgaccagtacacaaggtcgcaatatggcaggtgcacgcgctttatggcgagcaacaggaatgaaagaacatgatttcggaaaaccgattattgcggttgtcaattcatttactcaatttgtacccggacatgttcacttaaaagatatggggcaactagttgctactgaaattgaaaaatttggtggggtagcaaaagagtttaataccatcgctgtagatgatggaattgctatggggcatggaggtatgctctattctttaccgagccgagatttaattgccgatagtgttgaatacatggttaacgctcactgtgctgatgcgatggtttgtatttctaactgcgataagatcacaccaggaatgttaatggctgcattgcgtttgaatattccaacagtctttgtttcaggtggcccaatggaagcgggtaaaaccaaattatccgatcaaatcattaaattagacttagtggatgctatgattcaaggtgcaaatccgaatgtttcagatgatgtcagcgaacaaattgagcgttctgcttgtccaacttgtggctcttgttcaggtatgtttaccgccaattcaatgaattgtttaaccgaagcactgggcttgagcttaccgggaaacggctcatgtttggctactcatgccgaccgcaaacaacttttcttagcggcaggaaaacagattgttgaactgtgcaaacgttattatgaacaagatgatacatctgttttacctcgctcaattgccacaaaagaagcctttgataacgctatgagtcttgatatcgctatgggtggttcgaccaataccgttttgcatttattagctgctgcacaggaagcggaagtcaatttcactatggcggatattgatcgcctttctcgggtagtaccgtgcctgagcaaagttgcaccaaatacccagaagtatcatatggaagatgtgcatcgtgctggcggtattatggcaattttaggtgaattagatcgtgccggcttgttgaatagccaaactcgtacaattttgggtatgagcataggcgaacaaattgcaaaatatgacatcaaactcactcaagataaagccatacataaatttttccgcgcaggagcagcagggattcgcactactcaagctttctcgcaagattgtcgttgggatacggttgatgatgatcgtgaaaatggttgtattcgcagtaaagaatttgcttacagccaagatggtgggttagctatgttgtcaggcaatattgctttagatggctgtatagtcaaaactgctggagtagatgaaagcattttaaagttcagcggtaaagccattgtatttgaaagtcaagaagatgctgtatcaggcattttggggggtaaagtacaagccggacatgttgtggtgattcggtatgaaggaccaaaaggcggaccgggtatgcaagaaatgctttatccaaccagttatctcaaatctatgggcttaggtaaggcttgtgccttacttacagatggtcgtttctccggtggtacatcgggactgtctatcggacactgctcaccggaggcggcggcaggcggtttaattggtgtagtgaaagatggtgatattattgagattgatattccaaatcgtcgcatcgaattgatggtatccgaagaagaacttgctgagcgtcgagcagagcaagataaacttggctggaaaccagctaatcgccagcgagaagtttcctttgctctaaaagtttacggatatttcgcaacatctgcggacaagggtgcagtacgagataaaacgaagatataaaagttaaaagtgcggtgttttttatctaatcgtgccgtaaaaccacgtcctttagggggggatataaagcacaaatatgatatacttcttactgctaacagaggtcgctttagactctcaatgacggcataatcagggcaggacgtgcccgtagcgtctgtgaagtgaatcgcattggcggtcagcagcagaaaccctccgagagtagcccattgcttgcaatgggagctggtaggaatctccttgctttagctaggggaggacgtcaaagcagaaatggtagtgaaaatggcactttctgtaatagaaaaagttggtgatgattaataaaaataatcaaaaccaacttttgtctactgtgcttttttagatagcaggataaaatcacacctttttattagctattgaacttcaatactggcactttattttcggtgactgtttcttcttccactataactttctgtaagttttcaatagaagggagatcatacatagtatcaagcaatagggtttcaacaatagatcgcaaacctctggcacctgttttacgagctagtgcttttttcgccattgcaatcaatgcttcttgggtaaattctaattcaatattttctaagctgaataaaacttgatattgcttagttagggcattttttggctcagttaaaatttttaccaaagcctcctcatccagttcgcttaaaggtgcaataacaggtaaacgaccgataaactccggtattaagccaaatttcattaaatcatcaggttcaacttgcttaaataattcggttaaactgactttctcttcatcaatacgaacatcagcaccaaaaccaatacctttgccgccggtattcgttcttttctcaataattttatctaaaccggcaaaagcaccgccacaaataaataaaatcttagaggtgtccacacgcaacatttcttgttgaggatgctttcgtccgccttgtggaggaatagaagctaccgttccttcaactaattttagtaaagcctgctgtacaccttcgcctgatacatcacgagtaatagaaggattttcagacttacgtgtaatcttatcaatttcatcaatatagataataccttgttgagctttctctatatcataatcacaattttgtaataatttttgcaagacattttcaacatcttcaccaacatatcccgcttcagttaaagttgttgcatctgccattgcaaagggaacattgagcatacgagctaacgtttgtgccaataaagtcttgccactgcctgtcggaccgataagcaaaatattacttttgcccaattcaacctcagaagtatttttttcactgcgtaaacgtttataatgattatacaccgccacagctaatacttttttagcataatcttgacctatgacataatcatctaaatgtgcacgaatttcatgtggtgtcggtaatttaggctcttgctcttgaaattcttcatcaatttcttcgatgtcatccgcattagctaacatgtcatgacataattcaatacactcattacaaatataaccggatgtgcctgcaattaatttatctacttctttttgttccttaccacaaaaagagcaatgtaattctttttcttttgtcatttctttacccaatatctaccgtttaattaacacttcatcaactaaaccgtacaattttgcctgttctgcagacataaaattatcacgatcagtatcttgttcaatttgttcaatagattgtcctgtatgaaatgctaaacgttcatttaacgtttgcttaatttttaaaatttcttgtgcatgaatttgaatatcagaggcttgtcctctaaagccacctaaaggctgatgaatcatcactcttgcatgaggcaatgccgcccttttacctgctgtgccacccgccaataaaaatgctcccattgaacatgcttgtccaatacaaagagttctcacatcaggcttaataaattgcatagtatcataaattgccattccggcagtgactgaaccgccgggagagtttatataaatattaatgtcttttgctggatcttccgcttccaaaaagagaagttgagcaacaatcaagtttgccatacgatcttcaacttctccagtcagaaaaatcacccgctcttttaatagacgtgaataaatatcataagatcgttcgcctcttgatgtttgttctacgaccataggaatgacgctcatatatacctcttctaaaaaatctaaataacaaaagtgcggtcattcttacaaaacgaccgcacttaaaactataaaaagctataaattacgcttgagggttcattacttcatcaaacgaagacgctttctcagttacctgtgctttcgttaatacagcatcaacagcttgttgttctaacacgacattgcgaatgttattcattaactctttgtttttactataatattcaatcacttctgctggttgttcataagctgatgcaatatctgcgatcatcgctttaacacgttcttcatcagcctttaactcattagaagagatgacttcagagaataataaaccaacctgaacacggcgtttagcttgttcttcgaataattcacgtggtaattgtgcagcttgttgagcattaccgccaaaacgttgtgctgcttgattacgtaatacttcaatttcttgctcaactgcggcagtaggtacttcaattggattttgctctaacaaaccgtcaattacctgagttttaatacgagaaaccaaagcatttttcaattcacgttgcatattttttgcaatttcattgcgtaaatccgctacattttttgtattagggccaaattttgccacaaattcatctgttaattcaggtaattgcattacttctacttttttcaaagtaatcgaaaatttagcagctttcccttttagattttcagcatgatacgtttcagggaaggttacattaatttcaaattgttcacccgctttatgaccaatgataccctcttcaaaaccgggaatcatccgaccttgccccattgctaaaacaaagtctgttgattttccaccctcaaactcttcgccatcaacagagccaacgaaatcgatagtaacacgatcatcagctttagcaacatcttgagtttcaatccaagttgcttgttgtttacgtaaaatgtcaagcatcttatcaatatcggcgtctgaaatttccacaaccggtttttcaaccttgattttatccagtccttgaagctgaatctctggataaacctcaaaagtcgctgtaaattttaattctttaccagcttcaaattgttctactgtaaattctgggcgaccggctaaattcactttattttcaagcatcacattgaaaaaatgtttttgtaataaatcgcctaatacatcttggcgaacagatgcaccaaaacgtttttcaatcatttgtgccggtactttacctttacggaaaccgtcaatacgtgcattttttgctacacgtttcaattcttcacgcacagcttgctcaacagcttcagaaggaacggtgatatttacacgacgctcaagaccttgagttgtttcaatattaaatgacattatgttacctcaaaaagaatttgtactcggcggaaacacgcaccgaacacgttagtaaattaaatttacattaaaagacgaggaattatagcgatacaaaagcaaacagtcgaggaaatgacaaataaaaatctgcatttgaacattttttagcctaatagataaaatttttttgccaagaagtttttccataattttggttctcctgttgagaaatataaaatttctgatgttcgcatatcacaaaaagttatttttacgatccagatcgtaaaaaaagtgcgatggtattttccatattttctttttataacaaaattctcagtacatcattaaccgaataatataaacgcacaatatgataattcctcaatctgaagatatgtctccgatagtgatgtcgctcgatggagatacttatgaaataacaccgcacttatggcaaagaaatcagcaacaatcccaaattctgctacgctattttgccattcctttacaggaaaatgaacaaacgttatggttaggcgttgatagtctaaataatattagtgcctgtgaaacatttgcatttttgtatggaaaaattgtagaaccggttttacttaataaccaattacttaaacagttactacaaaacttatcaccacagcaaaataatatgttcgttgaagagcaacctataaatcaatatgtagccgagcatcgtatagaagtaactgaaaagtctgatgaacccgtgattcaacttttagatcacatttttgaaaatgcgttaaagcaacatgtatcagatattcatattgaaccgcaaatgaattgcttgcaaatacgtttcagaatagacggtattttacaatgccaatcgcctcttccgctttcgctgagtaagcgtattctttcacgtttaaagttactggccaaattggatataagcgaaacacggttacctcaagatggacgatttcattttaaaacaacattttctgacatccttgattttcgtttatcaacccttccgacgaatatgggtgaaaaagccgtgttgcgtttacagcaaaataaacctgtacagttgagttttgcggaactcggcatgacagaaaaccagcaaaaatcattcaaacaggcactatctcaacctcaaggactcattttagtgacaggcccaacagggagtggaaaaagtatctcactttacaccgcacttcaatggctgaatgataagcacaaacatattatgacagcggaagatccgatagaaattgaattgaacggtatcattcaatgtcaaataaatccgcagatcgggttagattttagccgactgttaagaacttttcttcgtcaagatcctgacattattatgttgggtgaaattcgggataacgaaagtgcaataatggcattaagagcagcacaaaccggacatcttgttctctcaactttacatacaaatgatgctccgtcggcagtttcacgcttgcttcaattgggtataaagcaacatgaaattgacaatagtttattattggtcatcgctcaacgcttggtacgaaaaaaatgtccacatacagaaaatgaaaattgcacttgtcatcagaaatatcaagggcgaattggtgtttatcaatttttacaaccgcatctaatggataatcatatttgctaccaaacggattatgctcatttgcgtgaaagtgcaatggaaaaagtgcggttagaaataacagatttagcagaagtggatagagttattggacaaagtagtgaataaaaaacggatcttcatgatccgcttttaacctatttaaactttttcaactttaacttgtttaatcatattatccgccacttctaatacagtaatttttagcccatttatttcacattcagttccttcattaggaatttcttctaaatgttctaaaatcaatccattaaaagtgcgggcatcttcggtatctaaattccaattaaataatttatttaaatcacgtaaattggcagatccttcaataattattgttccgtcagattgctgtgtcacttcttcatcaatagatggggcggttgaagtggtaaattcaccgacaatttcttccaaaatatcttctaacgttacgagtcctttaatatccccatattcgtctacgaccaagccaatacgttctttattgttgcggaaattaagtaattgagtatttaattctgtcccctcagggataaaataagtttcatctactgcacgaatgagcgtttctttactaaattcatttttatccagcattaggcgataagcctcacgaacccgtaatatacccagtacattttcatcaatactgcctttataaagtacaacacgcccgtgagcggcatgattcagctgacgcataatcgctttccaatcatcatcaacatcaataccggctatatcattacgtggcaccataatgtcatcgaccgtaactttctctaagtccaaaatagaaagaagcatttcttggtgtgcagaagggatatattgtcctgattgattcactattgcacgtaattcttctgagttaagagaatgtgcttttacttcattttttaaacgaaaaagtttcattagcccgctaataaatagatttataataaaaactaatggactaaaaattttcaatagtatgctaataatatgacttgaaacaaaagcaactttttcaggataaagtgcggcaatagttttaggaaaaatttctgaaaaaattaacattacaaaggtcaataaacctgtcgcaacggcaacgccaacatcaccatatatacgcatacctataatggttgcaattgctgatgcggaaatattaactaagttattgcaaattaaaattagactgaggaaaacatccgttctcttaagcaatttctctgttttttgtgcccctttatgccctttttctgctaaaaatcgcatacgatagcgattaacggaaagcactcccgtttcagaaccggaaaaataagctgagagaataagtaagataattaatgtaataaataaggtactaagggggatactatccaaaatataatcctttcattcatttccataatgccataatatttttacttatgacaatgagaccaagacattttataactctaaaataacacgactaccgaaataagcgacagtgagcaagatcatacctgaaattgtataaataatcattctttttcctcgccaatataatttccaatgtccaaataaagctataccgaaaacaaaccaagctaaaaacgaaaaaatagctttgggaatattatgagcggagaaaaaatcaattaattgaatgctaccggaaataagtgtcaaagtaagtaatatttgcccgctaaacaaagagcgaaagaaatgtttttcaacggtcattaatggaggaacaaccggcgagaaagttaattttttactttttaagctattatcaatccagcgtaattgaatggcatacaacatagcaataaaacaaacggaatatgcaaataaagataaggcaatatggaataataaacttgtattttgacttaaatgataaacccaaatttcaggtaataatgcttgtaaaattaaattgataatagaaaaacagtaaactataggcaacagaaaccaaagtgtttttactcgagccaaaatggcaacagttgcaatagcagcaatcatggcactcactaacgagcaaatttcaattaaagtgaaattattacctatgaacaaatgaataaataacttatttaacgcaagaaaatggctaataattgcgatgagtgcggtgactaaaaaagccattttattcaacttaacttcttgaccgccttgccctaataacattggcatgattaataaaatgctaattaaataaaaaaaagctgaaataaccgcaaaccacataaatttaccttacacaatatataataatggttcttattctaacttatccacttgataaaatcgctataaatttcttgcaaatgatgaaaatttaccgaatttcagtataattaaagcggtagttttttcaagaaaatataggattagaaatgtttgaaaatttatcggatcgcttgtcaaaaaccttgcgtaatattaccggaaaaggtcgtttaactgaagataatattaaagatacattgcgtgaagtcagaatggcgttattagaggctgacgttgccttacctgttgtccgtgaatttattcatcaagtcaaggaacgagcgattggcgaagaagtcaataaaagtcttacgcctggacaagaatttctcaaaattgtccaaaccgaattagaaaaagccatgggggtggcaaacgaaaaactcaatttagccactcaaccaccagctgtgattttaatggcaggtttacaaggtgcaggaaaaacaacctccgtcggtaaattggcgaaattcctaaaagagaactacaaaaagaaaataatggtagtttctgtcgacgtctatcgtccagcagcaattaaacagttggaaacattggctcaatctatcggcgttgatttttatccttccgatgtttcacaaaaacctgttgaaattgcacgtactgcattggctgaggcaaaactaaaattctatgatgtcctaattgttgatactgccggtcgtttgcatgtagatgacacaatgatggaagaaattcaacaaattcataccgcacttaatccaattgagaccctatttactgtcgatgctatgacaggtcaagatgcagcgaatacagcaaaagcatttaatgaggcattaccactgacggggatcattttaacgaaagttgacggtgatgctcgtggtggtgcggcactttctattcgtcatattaccggaaaaccaattaaattcttaggtgtcggtgaaaaaaccgaggcacttgaaccgttccatccagatcgtattgcttctcgtattttaggtatgggcgatgttctttctttgattgaagatctacaacgttcagtcgatcaagaaaaagcagaaaaaatggcacaaaaattcaagaaaggagatagctttactcttgaagattttcgtgaacaacttatcgaaatgaaaaaaatgggcgggatgatgtcgatgttggaaaaaataccaggtgcgagaaatctccctgatcatgtaaaaagtcaagttgatgataaaatgttcaataaaatggaggcaattattaattccatgaccttaaaagagcgtgctaatccggatattattaaaggttcacgccgacgccgaattgcattgggatcaggtacacaagtgcaagatgtgaataatctgttgagacagttcaatgaaatgcagcgtatgatgaaaaaaatgcgaaaaggcggtatggcgagaatgatgcgtggcatgcaaggcatgatggggggattaggtggattaggaaatatgtttagacgctaatatccacatatttatagggcgagttggatactcgcctttcttttattcagtttttgttaaatctctaatcttgcgatagaccacgtccaaattcgtactaaaatgaattttatgtatttctttcactgtcttagatttaacaatcgttcttaagggttggaactgcatattgcacatatgcaattcttgtgaaggcaacatatgttggataaaacgggtcaaagcatgaattcctccagcatcaagcacagttactgcatcacattgcaatacaatatgtttgatctctttccctgtatgagtagttttttcatgtaagtcggcaaacaagttatccgctgcggcaaaaaagagcggtccgctaatacgaaaaactacggtatcacacagatcctcaggatgagcaatttcaaaagatcttgtcatttcagcaatagtacggataaacaatagacttgctaaaagcacgccaacggtaattgcaattaccatgtcaaaaatgacagttaaagttaaacaagtcagcaagactgcaatttcattcaaacctgatcgacggattaattgaacaatttgcccaacgtttgccatattccaagcaaccacaagcaacaacgcagacatagaggcaagcggtaaataagacaatgcttttgcaaaaaataatagagagaataaaactaataaagcatgtatcacactggaaataggtgacaccgcccctgatttcacattagccgcagaacgggcaatagctgctgttgctgtaatccctcctaaaaatggtgcaacgatatttcctaacccttgagccaataattcattattagaatggtgcttagtactagtcatattatccaatatcaccgcacaaagtagagattcaattgcacctaatactgccatagaaaatgccgccggcaataaggcctgcaaggtattgaaatcccaattgatcacttctccatcagcattgggaaaattccaaggcaaaataatttcgggtatgacattcggaataccatatcccgtactatcgtctgataggctataactaaaagaagagcctattgttgccacatcaaagccaaaatgaatcaatgcaatggataataacgtaccgataataacagcgggcagatgaccgggtataggtaaacgaaacttatgccattttgtcagtaaaattagcgttacagttccaactgcagcatcagcccaattaatcgttggaagtgcggtaaaaattgcttgcaatttgccaaggtaatgtaccggcattgtggcgacattcaagccaagaaaatctttaatttgcaatgtcgcaatcacaatcccaattccacaagtaaaaccaagcgttacagagagcggaatatattcaatcaaacgacctagacgaaaaaaagccattaaaattaaaataatccctgacaatagagttgccatgagtaacccgcttaacccaaattgctgcgtcacagggtataaaatcactacaaatgccgctgtagggccggaaatattaaaacgagagccaccggacagagcaatcactatcccagcaacaatagcggtatataagccgtgctgaggcggtacaccgctggcaatagctaatgccatggacaaaggaatagcaataacaccaacagtaagtcctgcaataatgtcctttataagatgcgacttaccatagccaattttaaagctatcttgtagtgcactaaaaggacgaacggcaagaaaaatatttttagttaaaaaccactttttcaacatataaattccaacagacaagatgatagagagaagtattgtaactgaaatttaagctaataatttgttttagcacaagaaaaataaaaaatacttgactgaattagaagaaatctttatatttgccgccctaacttcaatggtgagatgtccgagtggttgaaggagcacgcctggaaagcgtgtatgtgggaaactgcatcgggggttcgaatccccctctcaccgccagagctcttcttttctctgtttttttctgtcttttttctttcattttttatcattaatccattgaaatataagaattttttgcgttttttctgtgtttttctgtgttttctctgtttttttgttatctgtgtttatgtgcctttttgttactaaatgatccctaatttgtgagcttttacttacaaaattttaattttggattttttagggatcatttgggatcttttgggcttgtttattcaattaaatcatgaggttagatgatggctaaaattaatcaatcttttgtcgataaactgaaaactacggggaaacaagagcagatttctttgggatataagctttttttggttatgtctcctaagggggctaaatcttatcgttatatttttcggcatcctgttactaaggctattaagaagaagaatttgggaaatgctgatgtgatgtctcttgagtccgctttgtctttggctatttcttttaattctttgcttgagcaaggtgtcgatcctgttgagaattttaaggcacaatttaagcctgtggagagggttgtttttactctgtctatggttgttgaggattggtatgttactaaggggatgcgtttgagcgagaaacatttacgcgataggttagcccgttttaagcgttatttgttgcctcactttggggagcgggaggttttggatatttctttgtttgaggctcgtgaggttattaaggctatttttgagcgtgcacctcatatgggggagaaggtggctcgtgatttgcgggagttgggcgatcatgctgttgatatgggggtttggagtgctaatcttttggctcctattaagcgttcttttcctcggcctaaggctgttaataatccttgtattcgggccgatgagttgccggaatttttgtgtgtgttggctcgctctcgtttggattttcagactcggcttttgattgaatttcagcttttgactatggtgcgggctaatgaggttgttactgctaggtgggttgatgtggattttgttaatgcggtttggcgtattcccgctgagaatatgaagatgaataaggcccatgatgtgccgttgagctctcaggccgttgctctgttgttggagttgcgtaagtttaatgctgataagccttttgttttccctcatcgctctattgacatcctccccggcctaaaggcaggggattcctaccagctcccacagcaagctgtgggctactctcggtgggtttctactgctgatctctattgagattcacttcatagacgcttcgggtatgtcctaccctgatatttattatgcttggactattgcttgcccacgtgtgagaacattcattgctcccactacatcggcattttctgtatagccacattctacacattcaaaatgagcttgagtttcacggttttcttttgcaatatgcccacaacaagggcaagttcgactagtattctgtgctggaacagcaactaaaaatccgccaagccattgcgttttatagtctagctgtcgtctaaattcaaaccaagattgatcccgtattgaacggtttaagcctgatttctgtttcacattttttccgtgtgcttccactgtgccttttgccgatttggacatattcgcaacttgcaaatcttcaacgtagatcatggcgtggtttttgctgatttgggttgagattttgtgcaaaaaatcttttcggcagttagckattttatggtgtaatttgccgattttttctttcagtttttgccagtttttactgaacttcactttatttttaagctgtttttgcagtttkgctaacttacctttgtaggttttaaacgcatttatcggctcaaaaaattcrccrttagacaacgtggcaaaacgtgccacgcccatatcaatrccgatttctccgcctttatgyryyggratktcgtgttcaaattccgtttgaatactcacaaaaaagcgtccgcacttttggctgacggtaacatttttcacttcgcccacaatttcacgactattrcgatarcgmacccaaccrattttcggcagrtacaagcggtcgtttycctgttcaattttgcaaccttgcggaaaacgaaaactctcttttatgccttttttcttgaatgttgggaaacttgaatgtttctgaaagaaatttttgaacgcactttcaaggtcttttaacgactgttgaagcacttgagaatggcattctttgagccaaattagctcttttttccattgcggaagtagattagcgattttgtaatagcggaatttatgattattatccagttcgtattgttcattttgccatgctaatgccttattgaacacaaaacgggaacaaccacaaaattgtttgattttgcggatttgttcaccatgcggtctaatttcaaacttaaaggctttacggagtaacattgcacaaattagaatacaaagattgttattattctacacttggtctatgaaaaaagaaacagagattagacgtggtcgccacgttgtttttaacttacacgttcatttggttttcgtgacaaaataccgcagagaagtttttactcaagcaattttgaacgacttacacaccatttttgaatccgtctgttcggattttgaagcaaaattagtagaatttgatggcgaagacgatcacgttcatttacttgttgaatatccaccgaaagtggctatatcaaaccttgtgaacagtttaaaaggcgtttcaagcagaatgattagaaagaaaaactatccgagtattcgcaaaaaattatggggaaatcagctttggtctccgtcttattttgcaggaagttgcggtggtgcacccatatctattattcgccaatacattgagcaacaacaaacacctgattagttaggtttgaaacggctatgccgcttgtgccttatatccacgccctcaaggacgtggttttacggcactgtctgataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatattttaataaaactttttcggctcacaaccgcataacatcatcatcttagcaatgatattccggtgtttttgttcctcatgaacaggcaatttaaaacgctttaaatcttccgctttaaaattcaatccttgcttatactgtaaaaaaaacttcggaaaatatttttctataatgctgaacaaataaaacgattgaatttgttcctttggggaaattactgcatatttatcttctattttgctttctttacgtaaatataggacctctcctctcgttgctgatatttgaataataattgtccctattggataaattttgtctttgcttggtctaggttctatttctgctacttctgttaaaaatcgcatttttattttcatgtaaacatcttacttaaaaagtattttttaatggtttcaagttgagaaataattttaagttcatgctcgataaagccggtgaattgttcaacttcttgctcagtaatgaatagcgagccttgcttactggatataagctgttgtatggctttcttctctttcgttcttggtgcaaaaacttgtgctaaaatttgttttacttgctcaaattcggctttatcctctgcactgccatgtgtcatttcaagttctgccaacattgcaacaaaggcttgaccgcttttttcaatatcattggttaaatccagtagctcttgtgcctccttcagtaaatcaatttcaggatcgggctctgatttatccacataacgcggaatatttaaattgaaatcattttgttgtatttctgtgtaattggctaaatgtgcgagcttatcaatattgtgccttaattgataagcggtaagcacttgattgacgtgctcaggtcgcataatgttattggatttcgctttctcaaataaatctgctgcatcgataacataaatatctgagctttgctttttaaargttaaaatagcggttggaatttttgcactgataaatagattatckggcaatcctatcacactcgakaaataaccttgctcaatcagtttttgtctgatttttccttctgagttaccacgaaataacaccccgtgaggaagaataaaatgtgccgttccctcctcttttaaatgatgtagcccatgcaaaacaaaggcataatcagctgcakttttaggtgctaagccaaaatattcaaaccgttcatcactcacgggrttccattttgcagaataaggcggattacttaccacacaatcyacttttaaccctcgccaatcyaattttgtgttttcaatatcgctatattgcccgtttctcgtcagtctatattctgcaaaagtttcaccagttaaaacatcacaatgcttaacttctgcggtgatgccacgcacacaaagattaaacaayaagaatgcaattgcctcttttgaatattcttgacaatagaaagtcgcattagggtttaccttccacttcgctattgttaacgccccggtacckgcacaaacatctaatacactatctacttcaggcgttaaccggmtcactaattggcaaatagccgatggtgtaaaatcctgttttaatgtttttctktctgcaaaattctcttgaaactcttgcagaaaacaatcttgacttaaatcaggtttttgagataaatatcgctcaaagacttcatctcgcttttgtttatcaaataacagattaataasatrctctgttatttgataatcccattttacattgagtaattcggttattttcatttggataattgataaatcaactmttcactaactccaacatttcccacgggaaagatmttttatctaatactkmtccgycttctgtttcaattgcgtrctctctgtcaayttggactattgcttktccttttktgctaaaatattsayyttgattttgtgcgattacgccataaactgcacckygccatgtgtctattttyactcttgascctacgrggaaaggyaatgtatatccgttttcggctacccattgttggatcatttcgctttcttttttktcgatagcaaaagaaaggyttttttcttcaaattcttttgcttstgcatarctccagccatrgwatttkatmaawtcttctgcyataagmtcatcgmwtycmkyccaatytcttaatagrgyttcatataagmctgtttcttcggcgggtatatsttcgcagtggtcgggatattcttcttcaatccatgctttaataaatgcakcaaaggcatcatcttcaagtgttgggcgtgggacttcggrgatccatttgttatttamtatcatgttgtttctcctgtttagtgggtttcttctaaaattggggtgattttgtaggcacggatttgtcgccccagcatttttttcgggactttgaattgatattcatagcctttttccggcgttgttgggctttgtaatatctttgcattagcgaggatttttagtgccatgttgcgtggatagccttgcgttgcttccttgaatgcttgtgggataacgtaaaaataaccgccttctcctctaaattcatcttctaggattttgatgccatagattttatttggggttttggcgttttgatctgctgggtattcaacaaaggcaccttcattcatggttatccagtccattaaattagcgatgagtttcgtttcttctcggctgttttcgccgtattcctctttccagttcaggaaattttttaatatgacttgttgattttcttcgatgctccattgggtaatatggctggcaagatgtaatgcagtttctagcacggcaaaacgatcagtagccactcgttgcacttggccgctcatgttgtcggcaagatctgcccattttttgcggatgattttataggtttcttttgcgagctctgcattttttgccagaaaggcgatccattctcgccctgcggtgccgtaatattctcttacgctttcgtttaagtggtcggcgtggcttttgttgttggtaaagtaatgtaggttttttgcctcttcgagagggatattaattaatcgcactaattgccctgcgtggacttttacgccttgcaaggcgagctgggtttcgaggtctttttcgcccgttgaaagtgcggtcactttccagcggtttatgtctttgtttcccccctcttttttgccttgtagtttgcctgtttcgttgaataggtcgtaggcgatagcttccagatttttagcatcttttgcttgtccgatttcgtccaaagtaattaagccgtcgttgcgtgctgccgcttcgttttttacgcctacggcggttgcactccagcttaatttgattttgtccgggtcgccataaagactattagcgatatttagaatagtggttttcccttttgagctttcggcgtataaatggacgccaaatgagtcacgtcctaaaatggctaataaaggtgcagcaagtgctacggcaacgcctagcatcatggatggattgccttttaggttttgtgctatttctctttgccaatcgtttaatgtgccttttgtgcggtagcctgatgcggatccgctttcgccattaaaatagataggtttactaggctctccgataatttcgccacttggcaataaataggcactatcttgccagcctgttgatgcggtgactttccagaagggagcttgtctgctgagcacatgaaaatgctctacaagatgattagtcagatttttggccgtcatcagtagccctttacgcttaagttgtcgccatcctgcttctgtgccaaagtcagcaaggcttacagcttctatatggctttctttttggctgaaatgtttccatttgaaaagatagtaataatcgccgatgtcgttgcgtccgttgcctacaagggttaatggactgcatatccaactgagcttttcattgatgacggcacctgtgtcccgatctaccttgggaacgacatagaataagccgttaagcttgccttcttctcgttcgtcaacataaggctctttgtgggtttcgatgtcgggttcatatcctacgacttgttccgcaaaggctaagtcttcgctgtccgttctgagcttttcaagatagtcgctcacatcttctaaaggttcgcccaataaatccacaaaaacaacgtcatttgctttgctgttttgtgccaggttaagcaaaagtgcggttttttttatgggggaaaattcccccgcttccattatacgcactttcttatggttttccgggataatgcgtaggcttgaaatttgttcgatttgtttcggccctaaaacaattggcttttcgggaagaaataccccgaatttgtctttaagcgtgccataatgggaaagaagatattttcctttcttgcctgcgtagctccaagcgtcctcgcctacgataataaaagcaatatctgttgtattgatggcttgctttttaaaatcctttacatttggggcgtttttgaggttctttttcttgactatcatatctcttcccttgaggttgaatagcgtcccagctgttcattttgggcgatttcacgccagcttttaaggtgcatatccaaggtataacaaaggttatccatggcgataaaatagcggtcgctttttttatgattaaactcggggctgtcggagcttgcaccgatatgttggatttcaaagagataatcaacgtaggcatttaaggttgaaattgtttctttgagctgtgcatccatggcaaaacgtacaacagaagatttagacatataaccccccttttgtattaatgcgagccacaaagacggcttgatgttgggtgagattgagctgttggcgtgcttgttggattgattttgcacgtatggcaatttttaggcggttttygcctaagaataggataaatttgaatagcattttgattgtctctttgtttagtaaatgtgaattgccgttccctaaagggtgtagcaaggcttcaactaccgctaataatcggctcgccttattcgtgcggataaactccgccttatctcgacgtatagaccttgccacaaattcagataaacagattgagcttagtaggctcaagccattgatgataggaatttgaggtaaaaaaattccgcaagtcttacgggtgcggtaaccgttattagtgatagtgtcgccaatactaaccgcactttgattttttagcaatactgaaaatttgatttttgtcatgtttctgtaccttttcaaactcatttaggctataatccatgacgttctttttagaactccatgattnattwctttcctatgagttaarttaaattacttgtgcccttgccatttggttgagggcttttttgttgggttatttccactaaactgggtgtaatcttggtgctgycccttagggttcttctatcgtttttgctatcrkctccaatcgcttactctgtatttcgtcaatatcgtcaatagaacagaataattkcgttagtactatgtctagtattttttcttgagataactgaacctcttgcccctcgtcattaaaagccattacgggctttttctcttttaactgaataattaaatctcttgaggtttctaatgtgttcttaatgccctctaaatcgggcttaaatgcgttttcttggtttgcttgataatttgtattactcatcatctaaatctcctttatagcttgaatatgcagctttaagcgtggtgatttcttttgataggttttgcatattaatcaccctcttttaacatattttcttttgcgttttgataaacgtcttttttaatttcgaaaccgtaactattacgccccagttctcttgctgctctaagcgttgagccactccccgcaacaggatcgatgacaacatcgccctcgtcggtaaaaatctcaatcagacgctttaatacatcgattggtttttgggttgggtgtaattttgggtatttcttgcggtcgtcccttgtccattccatccagtttttgatcatctttccgttattgcgaaacttcggcaatttctcgcggtaaagaattaaggcgtattctgttgcaccgacaactttcatgtttgcctttaagacttgtgggcttgaagacttaataaataccaaggggatatgctttttaaagccatacttctccgcatattcaaggaccatttggatttgttggaatgaacagaacacaatcatgcaaggcgcttgattacgctcttttggctctttaacaagcatttttgaacagaaatgcataaattccgcaatgcgaaagttttcatctgtgtcaaaaaaggctttgttggctttgtcgctttcgccgtttttattatcgccgtccttgtaccattccggactacttgcataagcgttattgcctacgttatagggaatatccgcaatgacaagctgggcttttgggatatggtagcgtttatagttttggaaatggtcgttaaaaagttcgcatttttgggtgcgtttgatgtgttccatttacgcctccttatgcattaccgcttaaagtgcggtattgttttgggttaattcgagcgtagcaaattgcattactgaggtttacgcggttgcgggcttgttgctcgttgttggcgaaaatactgaggtgtaggcggtttttgcctagtaaaatgaatttgtagatcatgagtgtaactccagttgtcattatgggagttaccgcacgcaaagtttcgaggctttgatattggcggcaacgtatcatgagctcgaaaactgcgtcaactggtacacagcaaagggcgaaacctttcccatgatacgctaccattgagattaaacactttgcaccataagcaaagggattaatttgagatgtgcgtagggtacgaataaaaaaagcacggtttaaaggcgtgctactattcgccagttgtctaacgttcgagtttcgaggctcggcacttgtttttttcaagtgcatattcatcttagtttaatccttttgcttaatcaacatgttttattatgaaatattttcatttatttgtaaaattgaatgaattactttaatataaaacaagattcataataatttccttggtatttctccttgtttgccccggttatgcactacgccggggctttttttatttgctgtttttgccatgcgattaggttttctctatcccaaatgggaatgttgcccattttttgcggtttggggattattccctgttggcaatatttgtagagcgttgaacggcttatgttgagaaattgacaaacttctctggttcgcatgtagcagctgacttgtattacgggttcttgcatagtcctccttgttggttggtttttcctgtcttttctgtttttctgttttctgttcgtggctatgttagccgtttaagtgggcttgggttggcaaatttgccaagatactttttttgattggcgttaggcttggttgtaccagttctcaagggttacatcggaggggattgccatattgagatttgctagtatatcgccatgttgatttcttaggcgttcgaggtcttgcccgagcttgccattgcgtagggcgttgcgggcttgttgtggggttttaatatcgtaatggagatataatagggttttgatgaaattaatttgatgttgtgcaatacgggggcttggcggtttgccatttgcccctgcgatgcggttagttctgttttttttgttgatatagctcaatgagcattttaagcacttcgggacggcttttgccttgttctttggcgattacatcgaattggtccgccagttcgctattgatgagcatgctaatttggcgtactttgccttcagcttttaggcgttgattgcgttcttttgcggtttgtgctctgagctttttactatgttctgtgtttgaatttgccatggttttctccttgatttttttaagtgggttgtttaagattggagccatcgggggaaactctgacctttccccctttggattgtctaaattagtaagctggagaactcactaccaacaacgctaataagattatgatgattgctaggaatttcatcattcttacttcgtttaatgccccgtaactgaacaagtcggggcgttcttgtttctagcccttgctagatgttttatattgtatatgcttatataataaaagcgagtatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttatttgttggcttatttgttctatctcttctatcacttctagcgggagtttaaaggctttaagtttaatccctcgctttgcatcagattttgcaactcgttcagcgtttgtggttgccctgtttttctcctgtctttgcttgatttttaaaagttgaagttgtatagtttaggaactgcctagcggtggcacccgctaggtcttacgtcatcctaataagccgattggcttattactaataggatgattagaatgatgattaaccgtggattcatcttctatttcctaagttgccccggtttctccaagccggggtttcttgtttctagccccttgctagatgggtttatattatataggcttatataataaaagcaagtatttcttgaaaaaataccgcactttttgggtgcggtttttttctatttgttagcttgtttaaaacattctagtgcttggataataagttggttttgcggtatgcccagttgttggcttatttgttctatctcttctatcacttctagcgggagtttaaaggctttaagtttaatccctcgctttgcatcagattttgcaactcgttcagcgtttgtggttgccatgtttttctccttgatttttttaagtgggttgtttaagattggagctgttagggaggatgcaccctccctaacatttgttatcttaattagtaagcgttatggcttatgcttattaagacaactaggatgatgattttgattagcatatcctagctccatttaatgccccgtaactgaacaagtcggggcgttcttgtttctagccccttgctagatgtccttattatattagataactaatattgatacaagtatttcttgaaaaaacaccgcacttttggggtgcggtttttttctatttgttggcttgtttaaaacattctagtgcttggataataagttggttttgcggtatgcccagttgttggcttaagttttcaatttcttttactactgttttgggtagcttatagcttttcgcttgcatgccgttttttttcatcacttttagcaacaatttcagttcttgacaatttcatctttaactcctattattttgaagtaccggggagccgttactccccgatttatcgtaactattaataagccgggaaacttagtaatagtagaactacgataaggaaaattttcatcaacatagtattttcctacttcaatcgttcagtatactgatttatacgagtcttttttaaaaaaataccgcacttttggggtgcggtttttttgttatttgttgctctctctatacatttcacaaagttttttaattgtttgcggtcttgatagacctagctcttgtgcaatagcatctaattcgtttgcatcttcggtggcaaattgcattgtgatacgtttgacaataccagcctctaggcgttttttattccattcattcgctgtttttattcttaatttgcgtgaatgttctgtttttgcgtatgccattgttttctccttgcttgattttgttagtcggtggttgtatattaggaactgcctagcggtggcacccgctaggtcttacgttatccttagtaagccggcacgcttaccaacatcaggataataaggattaatactttaaccaacataatccagttcctattttagttgagcggtgaaagtcgctcttcttatttccgccctattgcgaaaacgtgattagtatattacaataatatactaattacaagcattatcttttttatttcatttgtttttcttctcttttttcttcttctcttttttcttcttctcttttttctcttcaattcctaaaaaataggaacaaaattcctaaaaaataggaacaaaataggaaaaaataggaacactcaattttattaacttattgatttttaatgtattcattaaaaaaattcctatttttcctatttttcctaatttaatttcatgtataaatgtttttataataaaaaagcacccctaagggtgcttatttatttacatccacataatggaatgggcattggtcgatgttttgctctgataattgctccagtttttggatcttcacgagtccatctgaaaataatagggcaaacacagccacatttagaacaaatagttgtagccataagactaatctccatttgataagttgccatcacttatctatggacaataccgcacaatctgttttagaatagactaccgtttcttctatgttrtaggtatygtgtacagcggatggagaactrcacatagtaatyaatacgccaatattaattacttccagtaaagacccagccatttcagttgggttttttacattccgccaaaatcaagttctaattgcggtgatgtgtaaaatcctaatcgttctaaaactatttctgcaaatgtatcagcttgccattcagcatcttcattctttgtcggtggaacctttgcattatgcaataccgccctatgacctaaaaacaaatgaccaaattcatgaaatataatgaataaagatgttctatcacctctacaagctaactcataaatactttcaggaatagttattgtaaaagtacttggatcaaaatgacctcgcgttaaattccctgttgtttccttccattcttcatctgattttatagacaaattgataataaaattacttctctcctcaatttgctgaaaaaccttctcgcatttcttgcgtgatttttttgtaagtccgaattcgtggcaaaagttcaaggcggtggatataacttcaacttcttgcataggtgggaccctatttcctcgtaattgatatgaactcatttactatccttttcatgattaatacgagttaataattcagaaatttgagctagttctttagcggtataacgtgaattagcgaatccagccactagcatcttgtgatgttcagataaaccatctatcggaacattttcattagaaacatcggctaatttttgtaattctttcacctcgatgcctttctctttaaaaaaatgagttatcgcaacgacccattttttagatatttttttacttcctgtttctaatccgcttaaataagccggtgtagttcctaatgcttttgacattgtgagtaaggtttcattagcatcaattctagccttacgaactattttgccaaattctgtaagagccataatatattctcctagtgtgtagccatgtttgtatcttatttaaaagataccttaaaaagtaataaaattcaacttttttagttaaatttaaattttatttcctgtgccgttcctatttttaggataaaaataggaacaaaattcctaaaaaataggaacaaaataggaaaaaataggaaaaaataggaacactcaattttattaaatgattgatttttaaaatattcattaaaaaaattcctatttttcctatttttcctaatttaatttcatatataaatatttttataaatcatgagataagttaacttgttttttgtaatgaaaacattacaatagatatattcataaggagaacttaatgtactcaataaaacagacatcaatttttaagcaatggttgaagaatataaaagatcctattgctaggattatggtgattaagcggattgaaagagcaaaaaatgggaactttggcgatcataagctattggcaaataccggcggaatttatgaaatgcggatagataccggcaaggggtatagaatttattacgcaaaaattggggatattatctatttgctaacaaacggtggagataaaaaaactcagcaacaggatataagcgatgcccaagtgatattagaaaaatttaaacaattaggagatgatgaaaatgagtgaacaaaacaatatagaagtgactgattttgatgctgcagaatttttagaaaacgatgaattgatcgctttatatcttgcggagacattaaagaatggcaatgatgaagaatttattcaagcactcaatactgtggctagagcaaaaggcatgaatgatattgcgaaaaaagcggggattgctcgtgaaagcctttatcaaactctttcaagcaataagccgagatttgaaactgtgcgtaaaatcttaaatgctttaaatattgatctcattcctacggtaaaaacggcttaaatgccgtttttttctgtgccattcctattttttaggataaaaataggaacaaaattcctaaaaaataggaacaaaataggaaaaaataggaacagtcaattttattaaatgattgatttttaacatattcattttaaaaattcctatttttcctatttttcctaatttaatttcatatataaatatttttataaataaaatttgtattattgccgttttctatgaaaatttttcacttttttattctgcttatctgatcaaatatttacccataacaaaaaagcagaataccaaatgatccctaaaagatagttttaaaaacaagaacccttattgtataaggcttgaaccctcgaagcagatgaaccctctcaccgccatctaactgtaaaataaagtttgtcttgtaaaaaacaattaaaaaatcaataagttaccattccttaattgttcacattgtaaaataatgtttgtcattgtaatcgcttgatgttcccttttatgttccttttttgagagctaaaaaagtaacagcaacgttatttttatgtagagctaaaatctatgtaaacgtttgcttaatgaaagcgggctgcggtaaaataacccgattttatttaaagctaataaggtattcatatgacacagctaagtttgaaaaaaatttattcggggaaagtacgggatctctatgaaattgatgataaacgcatgttaatggttgcaacggatcgtttgtcggcattcgatgtaattttagatgatcctattgatcgtaaaggtgaaattttgacgcagatttctaatttttggtttaagaaattagcccatattatgccaaatcattttaccggtgaaacagtttacgatgttttacctcaagccgaggcagatttggttaaagatcgtgctgttgtttgcaaacgccttactcccatcaaaattgagagtatcgtacgaggctatttaacgggatcgggattgaaagattataaagccactggcacaatctgcggattaaaattgccggaaggtttggttgaggcaagtaaattacctgagccgatttttacaccttcaagtaaagcaaaagtaggtgatcatgatataaacattagctatgcggaatgtgagcaattaattggcgttgagcttgcaaagcaagtacgggaaaaagcaatttcactttataaagaggcagcggaatatgcactgactaaaggtatcattatttgtgatacgaagtttgaatttggtttagatgaaaatggtgtattaaccttaatggacgaagttttaacgccggattcaagtcgtttctggtctgtggaaacttatcaagaaggcactaatccgccgtctttcgacaaacaattcgtgcgtgattggctggaaaagagtggttggaataaacaggctccagcacctaaagtccccgctgatgttatccaaaaaactgttgataaatataaagaggtattggatttattaacaaaataattggaagtgcggtgaaaatttgttaaatttgaccgcacttttgccatgaaataagtttgagataatatgagagctgtttcaatcgtagggttagggtggttaggtttaacacttgcccgtcatttaaaaaatctgggttggaaagttaaaggcaccaaacgcacacatgaaggcgtggagcaaatgcgtttaattcgattggaagcctatcatctggaactcacacccgatattaatgctgatcccgatgatctaactgcattactttctgtggatgctttagttatcaatattccaccgagtcaatatttttttcatttacaacactacgtacagggcgttaaaaacttagtgaatgaggcattgttaaacggtcttcaacatattatttttatcagctcaacctctgtatttcctgatgtttcaggcgaatttgatgaacaaagtcagattgtaccccagtcagaaatgagtaaagcattgcttgaaattgagcaatggctgtttgagctgaaagatgttgactgcgatattattcgttttgggggacttgtgggcgaggatcgtcatcccgtttattctttagcgggaaaagatgaattatcagcagggaatatgccgatcaatttggtgcatgttgatgattgtgcaagagctattcaattgttattggaaacaccaagttcccagcgtttatatcatttggtcgcaccgcaacatccgactcgagcagaatattactcacagatagcagaaaaattatcactggaagcaccgcactttatttgttcggaacaagatccaagacgtgttattttagcgaataaaatttgccgagagctcagttttgtttatcagtgtccagatccttatttgatgttatttgaaagaaaataaaaaatatccgatttgcatttttaatcaaaaaaatgcaataatatgcagaatttattcaaaaaaaaatctataattcaaaaaagaaggtcataaatgtcaaatacaattttacaacatcttccaatcggtcaaaaagtaggtattgctttttccggtggtttggataccagtgccgcattactttggatgcgtcaaaaaggtgcagtaccttatgcttataccgctaatttaggtcaacctgacgaagaagattataatgctattcctcgtaaagcgatggaatatggtgcagaaaaagctcgtttaattgattgccgcaatcagcttgctcatgaaggtattgccgctattcaatgcggagcctttcatatttccacaggcggtgtaacgtattttaatactacgcctttaggtcgtgcggtaacaggtaccatgcttgtttcagctatgaaagaagatgatgttaatatttggggcgatggttccactttcaaaggcaatgatattgagcgtttttatcgctacgggttattaactaatccgagtttacgtatttataaaccttggttggataatcaatttattgatgagctgggtggccgtcaagaaatgtccgagtttttaatcgcaaacgggtttgattacaaaatgtctgttgaaaaagcttactcgacggattccaatatgttaggtgctactcatgaagcaaaagatttagaatatctcaatagcggtattcgtattgttaagcctattatgggtgttgccttttggcgtgatgatgtaactgtgaaagcggaagaagtgacggtcggatttgaagacggtgttcctgtcacattaaacggtcagtctttttcaagtgcggtcgaactctttttagaagccaatcgcatcggcggtcgtcatggtctgggaatgtccgatcaaattgaaaatcgtatcattgaagcgaaaagtcgtggcatctacgaagctccgggtatggcgttattgcatatcgcctatgagcgtttggttacggcgatccataatgaagatactattgaacaatatcgtatcaatgggttgcgtttagggcgtttattataccaaggacgttggtttgatccgcaagcattgatgttacgtgaaacagctcaacgttgggtagcccgtgcggtaaccggtgaagttacattagaattacgccgtggtaacgattattctattttaaatacagtgtcaccgaatatgacttatcatcctgaacgtttaagtatggaaaaagtggaaaatgcaccgtttgatccgtccgatcgtataggtcaacttaccatgcgtaatcttgatattacggatacacgtgataaattgggtatttatacacataccggattactgactgtaggtaaagattcaatgttaccgcaattggataaaaaatagtttttttacacgccgacatagttgaccgcacttttaagtgcggttagtttttgctacaattctccgttttaaaacaagcaggttatacaaacgacggattcatctgataatgaaaaatttattttcttttccttctttctatcagttttctaatgaaagacgttttttaaaacggttaagaactcgtattcgctattatttttatcgtttaacttgttttaaagaatgtcagatttttgttacctatttaaatcataatcctctttggattgatatattcacgaaaagttacaatcgttgtgatgctgtgcttagaaagtattgcgataaccgttttaataaaaaacaacgtgtacaagcaattatggataatttttccgtagcagaacaagtatttgggcggtctttctcacaactgttagttgaaaaagataaggttttattggctgaattaacagatgagttggatttgtatttagcaattaatcaaatagatccttttgagggtttttttgcggtaaatattcgcaataaacagggtcaacgtatttacgatgcctctttttcttttttggcagggaataaattattgatcacgtctgtgcaaggacctagtgatgataattcacaagaattaattaaatcgacaacgaagcaattacatggtgtacgcccaatgtttatgttggtaaatgtgtataaattgttagcaaaagagctgaattatgaacttttaggcatagcacataaaaatcaaggaaaatatcgttggaacgacaatgcacgtttgttatttaattatgatgatttttggcaagaaaataatgcacttttaaaccctcagggctattggcaattacctgtagttattgaacgtaagacgctggaagatattcaaagtaaaaagcgttccatgtatcgcaagcgttatgaaatgtttgattttattgaaaaaaatataactgagatttttggaaaagaaaatttgaataaatagaccgctctatttggtattcaagttttaaatggcatataatgagttgctattgatttttagtttgttttattaatttaaaggtatgactgtgacaactgaacgtattgcaagaataattgaatcaaaagaaattatgacacttctccctcatcgctatccgtttttattggtagatcgtgtaactgattatgaagaagggaaatggttaaccgcaattaaaaatgtgagtgtaaatgaaccttgttttacaggtcatttccctgaccaacctattttgccgggggtattaattttagaagcattagcacaagcaatggggattttggcgttcaaaactcacgagttaagtaataaagagctattttattttgccggtgtggatgaggcacgttttaaacgtcctattttaccgggagatcaaatgatgttaaaagttgaagtcattagggaacgccgtggtattaccgcttttacaggtgtggcgagtgtaaatggtgaagtagcttgtgaagccaaattaatgtgtgctcgtagataattaaggagcaaaaatgattcattcgactgcaaaaatccatccttcttctattgtcgaagaaggtgcaaaaattggtgaaaatgttgttattggtcctttttgtattgtgggaagcgatgtacaaattggtaaaggtaccacgttacattcccatgttgtcgtgaagggagtaactaccataggggaagataaccaaattttccaatttgccagcattggtgaagtcaatcaagatcttaaatatcaaggtgaaccaacgaaaacgattattggtcatcgtaatcgtattcgtgaaagtgtgactattcatcgtgggacagtgcaaggtggtggtgtaactcgtattggtgatgacaacttgttgatgattaatgctcatattgcacatgattgtcaaattggaaatcgttgtattttagccaataatgcgacgttagcaggacatgttgaattaggtgattttgttattgttggcggtatgtcagccattcatcaatttgttattgttggtgcacatgtaatgctaggtggtggttctatggtaagtcaagatgtgccgccttatgtaatggcacaaggcaatcatgcacggcctttcggagtaaatatagaggggctaaaacgtcgtggttttgataagccgacactacatgcaattcgtaatgtgtataaactgatttatcgcagtggcaaaacccttgaggaagtcattcctgaaattgaaaactatgcacaaactgaaagtgcggtaagttttttccttgactttttcaatcgatcaacacgtggcatcattcgttaatgggtagcctaaaataatgttgtaataaaataggaatgaaccgcactttttttaagtgcggttattttttatggtgtttttatgatagataaaaaaaatataacaattggcattgtcgcaggcgaagtatccggtgatattctcggtgcaggtcttattcgagcgttaaaaatacaatatccacaggcacgttttattgggattgccggtaaaaacatgttggctgaggggtgtaaaacgttagttgatatggaagaaattgctgtcatggggttggtagaagtaatcaagtatttgcctcgtttgctgaaaattcgtcgtttagtcattgataccatgttagcagaaaagcctgatatttttattggcattgatgcaccggattttaatttggatatagagttaaaactcaaaaagcaaggcattaagacgcttcattatgtcagcccttctgtttgggcttggcgacaaaagcgtattttcaaaattgctcaggcaacgaatttagttcttgcttttttaccctttgaaaaagcattttatgatcgttttaatgtgccttgtcgctttgttgggcataccatggcagatgccattgatttgcaaccggatcgccaagatgcttgcttccaacttaatctggagccaaaacatcgttatgtggctattttagttggaagtcgagaggcagaggttcaatttttaactcccccttttttacaaacggcacaattaatcaagcagcgttttcccgatgttcaatttttagtgcctttggtaaatgaaaaaagacgtaaacagtttgaacaaattaaagcccaaattgcaccgcatttagaggtcatttttctagatgggcaggcacgccaaacgatgattgttgctgaggctagtttacttgcctctggtacagcgtctttagaatgtatgctatgtaaatcgccaatggtagtgggttataaaatgaaaccttttacttactttcttgcaaaacgtttagtgaaaacgaaatatatttcgttaccgaatttattagcagatgacatgttagtgcctgaaatgattcaagaggattgtactgctgagaaattagctgaaaaattatctgtttatttggagcaaacggaaagtgggattaaaaatcgccaacatttaattcaacaatttactcaattacatcaactgattcgatgcgatgctgataagcaggcggcacaagcagttattgatttattaaatgatgaggtataaatgacaaatgtatttatttatccgaatgtggaattcattgcaggcgttgatgaggttggtcgaggacctttagtgggtgccgtagtgacggcggcggttattttagatccgcataatccaattgaagggctaaaagacagtaaaaaattatcggaaaaaaagcgtttgcttttggctgaagaaattaaacaaaaagcgttagcttggagtttgggacgggcagaaccggcagagattgataagttaaatatcttgcatgccactatgttagcaatgcaaagagcggtagaaaatttgaaaattcaaccgcactttgtattggttgacggtaaccgtattcctcaattgccgatgtcggcacaagcggtgataaaaggcgatagtttggttgctgagataagtgcagcatcaattttagcaaaagttgctcgagaccaagagatgatagaactggatagacgttatcctgagtacgcttttgcacaacataaaggttatccaacaaaattacatttggaaagattagctcaattcggggtattacctgaatatcgtcgtagttttgcaccggtgaaaaaattgttatcaactttattgtcaaaaaatcacgagtacattttcaaaatacaaaaataaatattatgttagaacctgttattgagtataatgagaactcagttttcaaaaggaaataatatggctacgcttttaaaaattggcttagtttcagtctctgatcgagcatcacaaggtgtctatcaagatcaaggtattcctgaactgcttgaatggttaaaatctgctttatgcgatccgttcgaagtggaaagtcgcctaatccccgatgaacaaaccttaattgaaaaaacactttgtgaattagtggatgattgccattgtcatttggttttaactacaggcggtaccggtcctgtaaaacgagatgtaacacctgatgcaactttggctgttgccgatcgtgaaatgccaggattcggtgagcaaatgcgtcaagtgagtttgcattttgtgcctactgcgattttatctcgtcaggttggtgttattcgtagaaatagccttattttaaatttacccgggcaacccaaagcaattaaagaaacgctcgaaggtgttaaagatgaacatggtaacgtcattgtgaaggggattttcagtgcagtaccttattgtttgcaactgattgatgggatttatattgatacagatcccaatgtaattgaaagttttagaccgaagtcggcaagacgtactttatagttgaaaagtgcggtagcttttttattttgtttgaggaagatgatgaaaaaaattgaagcaattattaaaccttttaaattagatgatgtacgtgaaagtttagctgatatcggtattaccggaatgacggtaacggaagtgcgtggttttggtcgtcagaagggacatacagagttataccgtggtgccgaatacatggtagactttttaccaaaagtcaaaatggagattattgtgcctgatgaaattgtcgaacaatgtattgaggcaatcattgaaaccgcacaaaccggtaaaattggtgacggcaaaatttttgtgtatgatgtaaatcgtgtcattcgtattcgtacgagagaggaaaatgaggaagcactttgatgtctgaaagaaattcatcgctaactcaagtgctggttgcttgtgctgcaattatcgttattttaggtggcattaaactcgccagtgagattgttgtgccatttctattatcgttatttattgcgattatttgctcacctgtggtgaattttatgactaaacggaaaatacctcattggcttgcgattactttgctttttgtattaattgtggtgttattttattttttagccagtttaattagtaatactgttcaggagtttactcaatctattcctcaatacaaggtactgttgtcacaacgtttaaatgatttgttagcttttgctcatcattttaatattcctttatttttttctaccgatagtattaatgatgattttgatcctagcattatcatgaaatttgtcagtcgttttttgttgagcttctcgaatgtggtaacaaatatttttgtgttgtttttgatagttgtctttatgcttgctgaagcacctactgtaaagcaaaaatttactaaattaatcgttactgaaaatactgttactcaacaaaattatattgaacgtattctacaaggcgttatcggctatttaggcgtaaaaacgattactagtgtgatgacaggattgtgcatttactttgttttatccgtccttgatattcaatatgctattttatgggctaccttggtcttcttattgaattatattcctaatataggatctatcattgcggcagtccctgttattgtgcaaagttttttattaaatggatttatcacgggtttagttgtcagtattgcatttattttgattaatactgtggttggtaacgttttagaacctaagatgatgggcagaaaattgggactatcaactttaattgtttttctgtcacttttattttggggttggttattaggaacagtaggaatgttgctttcagttcctctaacaatgggattaaaaattgcattagaggcaagtccaaatacaatcaaatatgctgagttattaggtgatgtaagcgatgtgcaaaatgttaaatgacgaaaatttattttttatcagactgtgccgtaaaaccccgtcctttagggcgtggatataaggcacaaatatgatatacttcttactgctaacagaggtcgctttagactctcaatgacggcataatcagggcaggacgtgcccgtagcgtctgtgaagtgaatcgcattggcggtcagcagcagaaaccctccgagagtagcccattgcttgcaatgggagctggtaggaatctccttgctttagctaggggaggacgtcaattgacgcaatatatctacaaaaggcatctttcttttcagatgccttttatcttataaaaacttctctttgtactttactaagtcttttttatgtagtgcaaagacgcctattccgccatttcttaattctaaccattggaaaggcacctctgggaattgttcgattaaatgaaccatactattgccaacttcacaaattagtattccattatcagtaagatagtcagcagaatttgccaaaatttctttagtaatagtcagtccgtcaattccggagcctaaagccatttccggctcatgatgaaattctataggcatatcctgcaaatcttcttcatccacataaggtgggtttgtgataatcaaatcatattgatcgagcggtaaatttttgaataaatctgactgaatagggaatacacgatgggtgaggttatgacgttcgatattgatttcagcaacatttaatgcgtcaatagataaatcaaccgcatcaacttctgcatgggtaaattgttctgcacaagcaatagcaatacagccacttccagtacaaagatctaaaattctgattgggtcttgttggagtaaccctttgaatttattcgtgattaaagcactgattggtgaacgaggaataataacacgttcatctacataaaattctaatccacagaaccatgcactattagttaaataggcgataggtaaacgttgctcaattctagcaataactaattgaatgagtgaatttttctctgaagtcgtgagtgctgaattataaagtttttcgggaaaatctagggggaggtgtaatccggttaaaatgagctgaagactttcatcccaagcattatcataaccatgcccataataaatatctgaacggttaaaaatgctataggtccatctgagaaaatcttgtattgtatgtaggctgttctgaacctgatctgttaaaatgcaatctacaagttcttggttaaactgatttatggtactcatattaattctctcaatcaaataaacggcgtagttataccatagttattcataatgagtaagttaaatttaaaaatagggaaaagtatgttaaatgatgaagatatagaattatttcatcgtgaaattcaaggagcaaaaaagatagaacagaatatttttattgcaccacgtcatcgaaatttaaaaaataaagtggagattcgcaatgttcgagaaaaagaagataccttatttttcttttcagatgaatatgaacctttattagatgaagaaagtgcggtgaaatatttacgtccacatgaagatcgttatttgttaaagcaattacgccgtggtgatttctcgcctgaactttttttggatttacatggtttgacacgtaaagaggcaaaaattgagctggcaagccttattcatgcctgtgaaaaggaacatgtttattgtgcttgcattatgacgggatatggaacttatacattaaaacaacaaatacctcgttggctagtgcaacatccaagagtaagagcgttacatcaggcacccagagaatggggaggcgacgctgcaattttggtattgttggacgtttagattatttgttagcatcaagtttagatgtacgttgattttgccggaaaaccgtataaagtgcgggtaatatttggttaatcagattaagttgttgcaatggaattgcgacttcatttcgattgaactgatcagcatgttcatcactaaattgttttaaagaaaactcaatatttagcaataatttttcaaaattatctcgttctaaagtttcaatatgctcaaggacatgaagtaattttttggcgataggataaaactcccctaaaaacaccgcactttgctgaattttctgcatattttttctatatgcacctaaagcagaaatataactcagtagcgaatagttaattttgaccagttcaaatccttcttgcaaataggcttgatattttttaggttcgctattcatgtttgatagggttgtacttaatgcggttgcatattcatgtgcttgccgtctggcaatacgatattttagcggatcacctttgccgaataatagttggctaatgatatataaaaagtatttagcattagcttttatcgcttgttttatcactttatttagttgtagatatttccaatccggccataaataagaaacagcactccaagcaataaagctacctattaatgtgtcggttaagcgagataatagagcgttatttaaatcaaatcccatgatattaaagctaattaagacttgtagtgtaataaaaaaagtagagtagctataattattgctacggaaaaagaaaaacaatgtactagtgacgacaactaaacctaattgcaattctaaagttggatgtatgtaaggcaatagagaaccgattaccacgccaagaattgtaccaatgatacgttgttttaatcttaacttagtcgccgaataattaggttggcatacgaaaacagcagtaagtaagatccaataacctaattgcaaattaaatatttctactaaactacagctaacaaaaacaatgatagatagacgtattgcatggcgaaaaagttgtgattcaaaggtaaaatgactacaaattgtacgccacatattttttaaaccaatgatctgctctgtatatatttgcgttccttcagatcgttcatttgtattttccgaatattgatccatatggtgtaattgccaattaactgcctgtaaattatcgattaatgttttaatggcaagtcgttgtaattgatttaagtgactgttttgataatgtatttcaaacgactgattaatacctaaaatcgcttgttccaaacgaggattgtacgaataggatttattgtattgcagactatgagcaatttcacgacaagattgtgcttgtagctctaataagcgttggatacgaaaaataagatccgtattttttaattgctctgataattgttgataattaaaatgacttgaattaattcgttcatgaatatcttgtgcagcaaaataatatttaatcatttttgtcgtacggcgatgtttatgttgtccacgaatgcgatgaaataatgctgtacgacaagcgttaaaggcagtaattaaattaccgtttttcatggcaagaatgacacgtttattttctaattgttcaatatcatcaggatcaaaaaaaagtgattttgtgtctaaatattctgataaagcaagaaaagcttttgtcatattttcttgtacagggcgatttggaaacattaaatgaacaaaaaccgtgcataaactataaagtaatgtgccacataaaattaaaatagggttgatataccaagaaacatttggtgtataagttaatgttgtataaagagctacaacgagtgtaccgaaagcaatagtgctataactttgccctatagcaccaaccatggtaaataaaaaggtaagagcggtcattaataacaaatattcaattccatgccctaaggtgagttgtacactaagagaggaaatagaaaaagcaattaatgtataaaatacatatttaagtcgtcctgttaatctattatccaaatcaactagtccgcctgcaataatacctaaaattaatggcatagactgttcggaaatatttagtttccaaatagagaatgtcactatatttactgctaaaaaaacaggaatggagagaatgatttttgtattaatccaaggggtcattttatattttttctaaactttttattattttaaccgctcttttaagtaaccttgatagtctagaatacgaatttcagtttcttgttggaatgcaggagaactaattaaaaaatcagcagtagcaatattcatcgcaacaggaatgttccaaacagttgcaatacgcattaaggctttgacatcaggatcatgaggaaccgcattcattggatcccaaaagaatatcagcaagtcaattttcccttctgcaattaagccacccaactgttgatctcctcccataggaccgctaagtaaatttttgatttctaaattcgtttcttgatgaattaaatttccagttgtccccgttgcataaagaacatgaggttgaagtaaagtgcggttagtttgacaccattgtatcaaatcttgtttgcagtgatcgtgtgcaaccagagcaatttttttgttttttgtcaatttgcgataggtggtttgcataatgatagtccttaataaaaaagtgagcttaggcccacttttgagttaaaaaccggttataaaattatttttggttttttgcccaattgaggaagcgaacttgagtttctttgtcggcttgttggaaccaaaactgtaattgttgctccgcaatattttcaccttgcacgacgacttttcctttttgtgctttagcaaatccgagagcaacagcaggcattgccgttgcaaagttggaaactgaagcaacagaaccggatgcattatattcagataatgtatcaattaggttagcccctggaaggaaaccttcttgcttcagtatttcttgttttgtcgcaattatttttccgctatttgttttgacgatgacagacggtgaatctttaaaatttttaatatctcgttcattttccagtttaggggctgagataactacgtcttcgtttgtgccttgaaatgtaacaacaataggatctgattcatataaagaacgatctgagccatgacgaacaatttctgaaacacgaacgacgacttggtgagtttgcgattcattgatattaaatgatttagtagattttaatagatctttattagctttttgtccatcaatagctaagaaatctatgtttgatgaactggttactataccggcaaaagctgctgtacttgttaatagcattgcacttgcaagtgctgcaaaagaaaatttcataattgctcctatagcctcaggaaatataatataaacttatccgcttttagaaaaagctaaccctgtatgctattccaaattaaataaaatgggaatagaaaaaactcgattatttgatttttttctatttttgtagtgaataagtaaaaaaagaaagcaaatttacttcttagttttttttcatttagtatattcaagaagaaattttgacgctgtggaaaaccgaatcataaatgttcgaatcacgatagactgccattctcaaataaaccaactatatagtccctgattgatcaacccgctttactttttattcattttcgaatagactgcctgaaggtgcaatttctcattgattcgtacgatttcttcatttctgtagggctacatatgaaaaaaatgtcggtattaatttggccttgcggtttttcatcattattgtcggcggtagaacgaccgatcctccaattaaatcgtattgatgcccaacagcaacaacgccaaaaggaacaaattcaacagcaaagtgaacgacttcgttccgatcccgatgtgagaatggaaatttcttcagaaaaacctaccgcacttccctttaatgaatctccttgctatcccattcaacatctttccattgtagattattcctccgataacaagacaaaacctagccaatttcaatgggcactgaataaagccgtcacgcaattaaacctccaattaccgcattgtttcggaactcaaggactagggattttgatgaaacaggtgcaaaataatgtgattgaacgaggctatatcacaactagagtggttgccggcgaacaaaatttaacgcaaggcgtattttctttaacggttattcccggtcaagttcgccatacgattattgccgatgtaagtagcctcccttggtttagtaaactgacagctaaaaccgcattggcatttaaacagggagatttagttaatatccgtgatattgaacaatccttggaaaatctcaaacgtgtgccaactgcagatgccaatatcgacattcttccggctgataacagttcagcattcggtgaaagcgatattaaaatcacctatcaacagcggtttccattccgatttagcttaaatttagatgattcgggttcaacatctacggggaaatggcaaggctctgccaccctttcgtgggataatcttttttctgccaatgatttattctataccactttcacacatagcttaaaacatcacagcgataattcggggcgtcgagcaacgagaaactatggcttctattattctattccttttggttattggacactctctgcttcactgtataaaacggattaccatcaagatgtttttggggcgtttgataatacttacctctatgctgggcgtagtgaaacaaccaatttaaatcttgcatatcgtctttatcgagatgcggtacgtaaaaccacaatttcaggcgggttttggtctcgccactcgaaaaactacattgatgatgctgaaattgatgttcaacgccgccgaatggctggttggcaaatcaaccttagccatattgaatatattaaggcagtaacactgaaactttctctaggatttaaatggggaacaggtgtaggtcgcaccatagcggcaccggaagaatattggagaaacggtacttctcgtcctaaaattattaccgcctcggtagacattaattatcctttctatatggggaagcaacccttggcatttaatacgaattggtccgctcaatggaataaaacccctcttattcaacaagatagattgagcattggtgggcgttatacggtgcgtggatttgacggtgagcttaccttatcgggcgagcgaggttggctatggcgtaatgaactcagttggaatattgcaaataaaggacattgggtttacttagccttagatggcggtagagtgatgggacgtagtgatggaatacgattagggcatcatttaatggggacagttttaggtctgcgtggtagttggacgcatttttattatgatgtatttattggacggccattaagcaagccgagcggttttagaacatcgcataccgtaaccggctttaatatcggcttaaccttttaatttagtgcattaggctcaaacgaggattttcttatgaataaacgtcagtttcgtgtgatttttagcaaaacattgcaacctattgtcgtggtttcagaaccggtaaaaaccgaaggaaaaacaaaaagtgagatgcctcaaatgcaaagtgcggttaattttctacccatttttgccgccttaactccccttgtctttcgtttgttctgtgctttgagttttgtcttttcctcgtctgtatttgcggaaaccttaatcatcaaagccgatcccaacgctcccaaaaatcaacaacctattgtgttgcaaacagcgaacggattaccgcaagtcaatattcaaaccccgaatgataaagggctttctcataataaataccaagattttaatgtagacaaaaaaggggcgattcttaataacagccacaaagacacacaaacacagcaagcaggttgggtacaaagcaatccttatcttgctcgtggcgaagcaaaagtgattctcaacgaggtaacatctacacatccaacccaacttaaaggttatgtggaagtggcaggcagaaaagccgaagtgatcatcgctaatccaaatgggcttcattgtgatgggtgcggtacgattaatgcgacacgctcaacaatgaccacaggcaaaccgcagattattgatggacaagtagaaagcattaacatagaaagaggcaaaataaccatcagtggcaaagggttagataacagtcgtgtcaattataccgatattcttgctcgagaagcggaaatcaatgcaggcgtttgggcggggaaaaagcttaatgtggtaaccggcaaaaacaccatcaaacaggcagatatggaacatggcggaaatgatttacaaattacccatattgacagccaaaatctcagtgaaaacgcaccgcactttgctttagatgtgagtgagcttggcggtatgtatgcggggaaaattcatcttgtcggcacagaacaaggactgggggtgcgtaatgcagggcatattggggcaagtgcggacaatttagtgattgattcacaaggtaaaattgtcaatcaaggaatgatttctgcgaagggaaatctacacgtcagtacgaaaaaagaaattcagaaccaagggcaattactcaccgaagctcagctaagtaccaaaagttctcatttggataaccgtggcggtaagattgaaggaagaaccgcacaaattaatgcgaccgagacagtgaataatgatcgcataggttcaacaggatctttgattcaaaccgctgaaaaacttgatattcacagcaaactcgttacaaacaaaaacacgaaagcgtcacaaagtaagccccctgaacaaggtattattgcaggtgtactgacaataaatggcgatgctcttgccaatcaaaacggggcaatttatggcatgcaaaatgttcaacttaatctttcggtacacttggataatcagcaaggcgaaattctctctcttggtgagttacaaattcaaggcgataaacttaatatgaataatgaacatggggaaatcgcaagcagaagtaatttagctatttatgccaataaattagaatctgaaggagaaattgaaagtagccacaatgcgagtattcacctcaagcaagatttaacgcttaataatgctttcaaagtaggcggtaatttagacttccaaacacagggcaattttatcaacaactcagttcttcgtgtgggagagaaactaagcatacaggctcataatatcaataataacagggagagtgagctatctggtaaaaacacccaaattctcagtaatgaaataattaatcgaggattaattgatggtgaaaaaaccttattaaaaagcaccgcactttctaaccttgggacagggcgaatttatggcaatcatttagccattgcgacaccaaatcttatcaatggaaaagaagacaatgcttcgccaaccatcgcagcacgtgaacgattagatttggcggtcggttcacttatcaatcgtgatcatgcgttaatttttagtgcgggagagatgggcattggcggtcatcttaatgaacagcaccatgctgaggggaaagcttcattcattgataatggcagtgcgactattgaggctttgggaaatgcttatgtgaatacagcacgcctacaaaatcacgacttacacttgcgattgggggaaaatcacaccgatgaacggcgagttgaatatgcaccgaaaaatacgtctcgacgctatgtattgatagataaagatggcaatcacgggcgatttgattcaagaaataatagtaggagcgatagaaattcttatttaaggctgaatgacggcacaaccattgcggctaatagttggatgcattgggattataatcgccacactattacgacaacgattgaaaaacgtgatccggctaaaattttgattggcggtgatcttcatttatcaggcaatgatcttgaaaataatgcgtctactctttctgtaggaaaacgcttattactcggtgatgaggtatttataaaaaatgataaaaatgaaacgttacattccacaaccggtacatcgctcaataatattgatattgcaggaacgataaatgttacggacaaaggacattgggatagcttccataaaaagaaacgtcgctatggaataggggtaaggaaacgttgggcggtttatggtaccggaagaggggatttgaatgacattcacccgacgagccatttcttcttcaataaggtagataatactatcggtcagcctgttgacagcaccaacacgcaaattacagctcaagctgaggcgattgtgccaaaccaaatgaatggcgtaattattaacttaccggaacaaagtctatatcagattaaccccgatgcccctaatggttatttagtggaaaccgatccgcactttactaaccgtaaacaatggcttagctccgactatatgtttaacgcattgcgttacaatcacgaaaatgtgcagaaacgattgggagacgggttttatgaacaacgcttgattaatgaacaaattcatcaactcacaggacgacgctttttagataatcaccaaaccgatgatgagcaatacaaagccttaatggatagcggtatttattatgccaaaaaatttaacctgcacctcggtgtcggcttaacagcggagcaaatggcagagttgactgcggatatggtatggtttgtgaataaagaaattacgctaccgagcggtaaaaagttgacagttctcactccacaagtttatcttgttgcacgaaatcttgatgtaacttcacaaggtgctttaatttcagcgagagaaattatggggcatattaacggaaaacttaccaatacgggaacgattgcggggcaaaatctgaccgcactttctgccaagaatatcaacaaccaagggcttgttttgggggattccgtcaatttacttgcaaagcaaaaattagttaacctcggcggtagaattgaagctcttgattcagtgacattagtcggcaaagaaggtgttgacattgcaagtacaacaactcgccgagcttatcaagatgactttggtaataaatttgaccgcactcatgtagataaccttgccggtattcatgtcaaagataaaaacggtaaattaattgttcacagcccaaaagatgtaactattaaaggtgcagaactcaatagtgcaggcggaatacttgttcaagccaaccatattgatattggtacccttaatacaaaaaataaaacggattacaatgcggatatggataattactaccgcttagaacagcatcaagaagtcggttctcaattaaatggaaaaggtaatatcacccttgccggtgaacagggcgttgtgattcgccaaggggaaattcatagcgagaacggtgatgttcatattgcctcaaacggtaatattcgcattgaagaagggcgtaacaaagagcggctttcttctgcctctaaagtgaagcatagtggttttcttcaatccacgacagatatcactaaacacgagcaccattatgatttagctcaagggtcaacccttgatggtaagaatgtggtgttgcaaagcaatgctaacctgacggttcaaggctcaaatattgttgctgaaaatcagctcaatgctcgagcgaaaaacatcgcaattaaggaagcagaaaaccgtgttttcgaacaagatgttgagaaaaccacgaaatcaggcttaatgggttcagggggatttggctttagcattggcgaaaagaaaaccaccacagaaaccaatcaaaccaaatattacgccacaggtagccaagtgggaagcctgaaaggtgataccgcccttattgcaggcaaacactaccaacaaaccggtagtaccgtctcttcccttgagggcgatgtgattattggtgcgaaaaaagtcgatattttggctgcagatgaccgatacgaaagccattataaacagacgatggaacaaaaaggttttacgattgcggtgaatattccggtggtgcaggcggtacaaaatgcccttgcggtagcgaaacaagccgaacaggtkggcgamagyaaamacwrycgaatyaatgcsatggcagcggcgaayactgcrtggagtgcgtatcgagcgggacaagggttaatgcaagcgagtcaaagtctcagccaaatggcgaacggcratatggcacaaggggcgaatgtcagygtrtcyatcacttatggcgaacaaaagaatgtgcagaccacggatatccaaggcaacackgcrgcaaacagtgcgataaatgcgggtggaaaagtcaccgttrcygccaccggagcgggcaaggaatcggatattcacrttgtggggtctgacgtatcaggtcaacaaggcaccctcttacaagcagaagatgaaatcaatktwckkrcagccaaacaaacscaccaagagcggagccaaaataaatccgccggytttaatgcrggtgtrgcggtgagttacggctcaaatggtttagcctttggatttaccgcagggggaaattatggcaaaggctatggcaacggcgatgaaaccacctaccgtcatagtcatattggcgataaaggtagccaaacccacatcatgagcggtggagatacgacccttcgtggtgcacaagtgcgaggcaaaggcgtacaagttcaagcccaaaacctcaacattgaaagcctgcaagatactatgacctataaaggcaaacaaatgaatgtgagcggacaggtaacggtgggctatggcttttccgcctccgccaatttcaatcaatcgaaaatcaacgccgattatgccagcgtacaagaacaatcggggatgtacgccggagataaggggtatcaaattaacattgcccaacacactgacctcaaaggcggcttaatcacctccactgaacaagccgaaaaccaaggtaaaaaccaattcagcacaggcacactttcttattcggatattcaaaatcacgctgattataatgggagtgcggttggtgtaggagtacaagcagatattaacggtggctgggatggtcgtcaggttagagatggctcaccggtaagtcgagtgaatcaaggtatcggctttggttatgacaaagamagccaatcyagcstaacaaaaagcggcattaatacgcaaaacctcatcattcgtgacgaacaaggacagttggcgaaaaygggaaaaacgatagaaacaacaagaggggaaatcagcacaaacatcactacggactccgcagagcaacatacaggcaaactggcacaaaactttgataaagagcggttacaaaaagagttggatttacagcgagaagttacgcaaaaatttgatcaaactcggcaggaagttaaggctgaactgtatgatatcgttgatgaaaaacgagaaaaggcaacgcaaattcgaaaaatcaatggtggttatgataccgaactttccgctcaattagatcgtgaggcaacggatttagatgaaaaagtgcgttggttagatatgggattaggtcttttacaaggtagcgtgggaaatagcaaaacaatgttaggtgtttttgcgggcactcaagccgatcgtgccgttcgttcagcaactgcacctaaagaaatgtggtatcacaagaaagtaattaatgaaaaaaccggcaaagtgaagttagaatcaagacaaatttggtcattgaatgatttaagcagagaagaactggcaagcattcaagacacaaatggcaaagttattactgtgtctaatcctggtattttcaatgatcgagaagattcattaagcaacgcagaaaaacaaaatcttaatagtacaaacagcagtggtgtcattgtggttatgaatcctccaacagggaactataaaggctggtggatactgtcttctatggtttctgaactgatgtatgtcggttacgaccaattgaataataaagtgttccaaggctatttacccaaaactaattcagaaaaattgaatcaagatatttatcgagaggttcaaaaaatgggaaatggctggtcggttgataccgacgatcatagtcgtggtggtattacagccagtgttgctttaaaagattgggtaaacaataaagagcaaaacggcattgccccaatcagaaaagcacgtttctatggtacagccacaaatgtgcaraatgattawgccgatgtkttacagaaaaacggttatacctatacgggtgaagacggmaaaacttataayagcggagcctactcaatcgtgcatgataaagattttgtggggaacaaatggatacctttcttattaggaaccaatgacacaacaaaaggaaattgtgggatattttgttattcgcacagttcgtattttgcggaagtgcctgaacagcaccaaagggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattcctaaattaatcaacccaaataaaccaaatggagaaaagtatgaaaaaaatcctttctaaatattttatgctaatnnnnnnnnnnnnnnnnnnnnnnnnnnnnnnnnnnnnnnnnnnnnnnnnnnnnnnnnnnnnnnnnnntaggtgtgcagattggaattgttctaaacctacgccaagatggagaaaggcagttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgatattggtacccttaatacaaaaaataaaacggattacaatgcggatatggataattactaccgcttagaacagcatcaagaagtcggttctcaattaaatggaaaaggtaatatcacccttgccggtgaacagggcgttgtgattcgccaaggggaaattcatagcgagaacggtgatgttcatattgcctcaaacggtaatattcgcattgaagaagggcgtaacaaagagcggctttcttctgcctctaaagtgaagcatagtggttttcttcaatccacgacagatatcactaaacacgagcaccattatgatttagctcaagggtcaacccttgatggtaagaatgtggtgttgcaaagcaatgctaacctgacggttcaaggctcaaatattgttgctgaaaatcagctcaatgctcgagcgaaaaacatcgcaattaaggaagcagaaaaccgtgttttcgaacaagatgttgagaaaaccacgaaatcaggcttaatgggttcagggggatttggctttagcattggcgaaaagaaaaccaccacagaaaccaatcaaaccaaatattacgccacaggtagccaagnnnnnnnnnnnnnnnnnnnnnnnnnnnnnnnnnnnnnnnnnnnnnnnnnnnnnnnnnnnnnnnnnnnnnnnnnnnttgagggcgatgtgactatcggtgcgaaaaaagtcgatattttggctgcagatgacagatacgaaagccattataaacagacgatggaacaaaaaggctttacgattgcggtgaatattccggtggtgcaggcggtgcaaaatacccttgcggtagcgaaacaagccgaacaggttggcgaaagtaaaaacaaccgaatcaatgcgatggcagcggcgaataccgcatggagtgcgtatcgagcgggacaagggttaatgcaagcgagtcaaagtctcagccaaatggcgaacggcgatatggcacaaggggcgaatgtcagtgtgtccatcacttatggcgaacaaaagaatgtgcagaccacggatatccaaggcaacacggcggcaaacagtgcgataaatgcgggtggaaaagtcaccgttgctgccaccggagcgggcaaggaatcggatattcacgttgtggggtctgacgtatcaggtcaacaaggcaccctcttacaagcagaagatgaaatcaatttacgggcagccaaacaaacgcaccaagagcggagccaaaataaatccgccggctttaatgcgggtgtggcggtgagttacggctcaaatggtttagcctttggatttaccgcagggggaaattatggcaaaggctatggcaacggcgatgaaaccacttggcgaaatagccatataggcgataaacacagccaaacccacatcatgagcggtggagatactgccattaagggagcccaagtgcgaggcaaaggcgtacaggttcatgcccaaaacctcaacattgaaagcctgcaagataccatgacgtataaaggcaaacaaatgaatgtgaaaggacaggtaacggtgggctatggcttttccgcctccgccaatttcaatcaatcgaaaatcaacgccgattatgccagcgtacaagaacaatcggggatttatgcagggaatgaggggtatcaaattaacattgcccaacacactgacctcaaaggcggcttaatcacctcgacagaacaagccgaaaaacagggtaaaaaccaattcagcacagacacattcacctattcggatattcaaaatcacgctgattataaaggcagccgtatcgggttaagtggttcaatggcaataaactttgacacgccgttaggcaaatacggacaagtgcaaagtaataaacaggcggtgaatgacaaaggggaaaaactttacatagatagccaaggcaagcaaaccaccacaagccgagacagtgcaggtaatgcaaaccaagccaaattggcgaaaggtttagattctttaacggggacgacctctttcggattcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaccgttgaacaaataaaaacggaaattaaaacggacataaccaccgacaatgccgaaagccgttcgggtaagctagaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagatactatgacgtataaaggcaaacaaatgaatgtgaaaggacaggtaacggtgggctatggcttttccgcctccgctgatttcaatcaatcgaaaatcaacgccgattatgccagcgtacaagaacaatcggggatttatgcaggagatgaggggtatcaaattaacattgcccaacacactgacctcaaaggcggcttaatcacctccaccgcccaagccgaaaaacaaggtaaaaaccaattcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacaggtaacggtgggctatggcttttccgcctccgccaatttcaatcaatcgaaaatcaacgccgattatgccagcgtacaagaacaatcggggatttatgcagggaatgaggggtatcaaattaacattgcccaacacactgacctcaaaggcggcttaatcacctcgacagaaaacgcagagacggaaaaccgcaaccaattcagcacagacacattcacctattcggatattcaaaatcacgctgattataaaggcagcagtatcgggttaagtggttcaatggcaataaactttgacacgccgttaggcaaatacggacaagtgcaaagtaataaacaggcggtgaatgacaaaggggaaaaactttacatagatagccaaggcaagcaaaccaccacaagccgagacagtgcaggtaatgcaaaccaagccaaattggcgaaaggtttagattctttaacggggacgacctctttcggattcggctatgacaaagamagccaatcyagcstaacaaaaagcggcattaatacgcaaaacctcatcattcgtgacgaacaaggacagttggcgaaaaygggaaaaaccgttgaacaaataaaaacggaaattaaaacggacataaccaccgacaatgccgaaagccgttcgggtaagctagaaaataaatttgataaggaaaaagtcttaaaagaacttaatattcaggtaaaagtaacacaggagttcaggaagaatgcattttcgacgatagatgcttatgtactgccaaaacaggctgaattaagggaaaaaataaaagcagcacaaactgaagaggaaaaagatgaactgtataaggaaatttataaattgcaatatcaaaaacgcttgttagaaacgacagtaggtattattgccggtacacctgagattgctattacacaaggaacgctacaacttgcagcgaccaaaatgcgagaagaaacgctaaaaaattcccgcttatttaaaggaattaaggataaaaagacgggacaaatattgagaaatgacagttacagtagtggttattttgatggcgtgaagttaggtggtgtacgaattgatgttgatgtgatttgtaatagcggaatgggggcttgttctaaaaataatgatggttctataacttttaatggaaccaatgattacacacttaaagatgcaatagatcctacacaaaataataaagcaaaagatttgtatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaggggaagtatttccatccatatctcgctatcagaaaccgtatagtttaggaagaactgatagtaatcaacgttggaaagatgtaatttcttgtggtggtaaatatttggattatgatcaaagaagtgttcctttcgagaaacaagaagaattttattattgtatgctgggtaaaggatatatccatctttcccctgcaaaatgtggttatcaaaaccctaaatgggataaaggggtatgtaatttctaatttaaaatgtagatatattacctctgtcaaagatgaaaaagatttaattatgaataaagagagaactatttatgatttaaatagaaataaaagcagcaaataacggagaaatagcaatgaaagtatttagtattattagtgttttccttttgattgggtgctcattcggtggattcaaaccacctaaaccatattatcagtggcgttttgaagataaaaattttgaaacatcttatgaatatgctgtttttagaggcaaagaaatgcgatcttgtggaatggatcctgtattaggtgaaagtgttaaacttaaagtcaatttgtgtatggaaaaaaaaggatggtatctaaaacaaggtccggtgtgtgaggaaaaatatgtatggaatgagccagaatgtattaaatggcgggctaaacacagtaaacctgatgcaaaaccatgggaataataatttacaacagactgaaaggcaattatgttcacctatatcaagaagaataagaaagtattggctgaaatcactgcgtatagaagatatttttaggactaatcaaattttacatcaagaatcaagtaaaaatttgattttaaatggtgcccgagggcggacttgaaccgccacagctcgaaagccgagggattttaaatcccttgtgtctaccgatttcaccactcgggcaagtgtcctgactcggttatgtgatggaggcgtgtcccggagtcgaaccgagctacatggatttgcaatccagtgcataaccgctttgctaacacgccgtagcgtaaattggagcgggaaacgaggctcgaactcgcgaccccaaccttggcaaggttgtgctctaccaactgagctattcccgctttttcgctgcaacacattcgctgtcagtggtgcgcattttacttcgttatgaaaaactgtcaacaattcttttgaaaaaatatgttaattgatgaaaaaaaactcaaaacaggtatttaagaatacaatttatacagaatgtgtttgtttttagtacatcactatcacttatttcatttatctattttaatgatatagaaaatattctttaatcactggaaactttgtgcaacaatgcaatcctattatgtcgtacaataataaaatatagctaaaagtgcggtcgtttttcttagattaattaggtgaagttatgacacaacaatatgctctagatacattactggctcaggccggtaatagaacagatgaaagaaccggtgcggtatctacgccgatttttctttccactgcttatgctcatcatggaattggtgaaagtacgggatttgattatacccgcactaaaaatccaacgagaacggtattagaagaaacaattgcaaaattagaaggtggagatcgtggatttgcctgttcttcaggaatggcggctattcaattattgatgaacttatttacgtcacctgatgaatggattgtttccagcgatgtttatggcggaacttatcgtttattggattttgcccataagaatacgcatggtgttaagcctgtttatgtcaatacagcttcaagtgaagaaattgaaaaggcaatcactgagaatacaaaggcgatttttgttgaaacgccatcgaatccgttaatggaagaatgtgatgtggcagaaattgcgaaaatagctaaaaaatacaatttgctattgattgtagacaatacttttttaactcctgttttatttagaccaatggaacatggtgcagatattgttattcatagtggaacaaaatatattgctggtcataacgacacattagtagggttaattgttgccaaagggcaagagatctgtgaccgcttatattatattcaaaatggtgcaggtcccgtattatcaccttttgattcttggttgaccattcgaggcatgaagacacttgcattgcgaatggaacgtcatcagaaaaatgcacaggaattggcaaactttttaagagaacagccacaagtaaaagatgtgttatatccaaataaaggagggatgctatcttttcgtcttcaaaatgaaaattgggtaaatccttttcttaaagcaatgaagttaattacttttgctgagagtttaggcggtacggaaagtttcattacgtatccggcgacacaaacgcatatggatattcctgaggttgaacgtattgctcgaggtgtatgcaatcgtttactacggttttctgtaggattggagaatgtagaagatattaaagcggatttattacaggcattttctcaactaaagtaaccgtactttaatagatcaagatttaataaaagtcgcaacttatcatacgtaagtaatttgtcgtggtttatgttgtgatttttcacttgaaaagcggagatttatctttatactctctaactggaaataataaatcccaaacaataaaaggaagaaaaataaaaatgagtgaagtattacatacaacagatgcgacttttgatactgatgtattaaaatcagatattccagtattattagatttttgggctccttggtgtggtccttgccgtatgattggacctattctagaggaactttcagctgaattaggtgataaggtaaaaattgttaaaattaatattgatgaaaatcaagcgacaccggctcaatttggtgtgcgtagcattccaacattaatattcttcaaagaaggtaaggctgtcgcaactcaggttggtgcattaccaaaaaatcaattagtaaattttatcaaccaaaatagctaatatgtagcttaaacaagacgaactaaaatagcttaaatctcaaaaggatttaagctattttgtctattacacctttaaatcgtatgtaaaatcataaaacattacctttggtaacggttaaagatttaatatttctttcacaaaaggaatagtcaacttacgttgtgcttgtaatgaggctttatctaataaagttaacgtatcaaataaagacttaatatcacgatctaaacgttttaataaaaaattagctgtatcatcaggtaattcgatccctcgttgatgggcattgcgttttatcacttctactttttgttgttcatttagtggatttagctgataaatttctccccaacttaatcgtgaggcaagatcgggtaaagagatatttaaattcactggagattgattggcacttattaacagtaatgtactcccgctctcttttattctattcattaaatcaaaaatagccaattcccattcatgatttcctattattgcatggaaatcatctaaacaaaccaactcttgctgttctaaattttccaaaacttcaggggaaaaatattgtgctttactcaatggaatataaatcgcattgcgttgcgatgctaaaaaataattggaacatgctttaagtaaatgagttttacctgtactttttcctccaaaaatgtaaaagaaaggttgatataattgaataaaatttttacgtaatgaaccgagtaacaataaattattgtcgctacaaaaattctctaaggtatcatcgtctatctgatgaataggcaaagggagttgttggctcaaaaaataattccatttgatagtaaagttgactcataatacagaaaaaataggaacaggtgaacctattcctattaatcttgtaaattttagtcttctatttgatttttagccgatggtaaaatgagatttagaataatagcgacaacggcacataaactaatccctttcaaggataattctcctaaattgacaaacattccaccaattccaaaagtcataaccacagaaataatacataaattacgtgcttccgtcacatcaactttcccacgaattaatgtactcatcccaacgacggcaatagagccaaaaaccagcatcataattccgcccataacgaaggtggggatcgtagataggaatgctccaactttgccgcaaaatgaaattgcaattgcccatactgctgcccaagtcataatagtcggattaaaatttcgggttagcattactgcacctgttacttctgcataagtggtatttggtgggccgcctaatagtgatgcggcagatgttgcaagaccatcacctaataaagtgcggtgtaaccccggattttttaagaaatctttgccggttacagaactgatagccatgataccgccaacatgttcaactgccggtgcaatcgctattggtagcaaatataagatggcttccagtttaaattctggtgtcgttaaattcggtaaggaaaaccaagatgctttggcaataggactaaaatcgattaatcccataaataaactcaagatataacccaccgcaatgccaaacattatcggtattaatttcatcatacctttggcaaaaactgctacaattaaagtagtcaatagcgtaatcattgacacgagaaccgcatcaccatattcatagttactgcctttgccggtcgccatatctacagccacaggtgccagtcctaatccgataatgataataacgggtccaacaacaaccggaggaaaaattttctgtaaagcccccgctccacgtaatttaaccaacaggcttaaggcaacataaacaagtcctgcacaagcaagaccacccattgttgccggaattccccatgaggctacaccatattggattggtgcaataaaagcaaaagaagaggctaaaaagatcggcactttcttgccggtacatagttggaaaagcaatgtaccaattccggcggttaataaggcagtatttgcgtccaatcctgtgattaatggaactaataccaatgcaccgaatgcaacgaataacatttgcaagccaataaaagcttgtttgattttgcccgaaatttctacggggatattttgatttgtcatttaagtttcaactctctgtctgaattaactaaaagtgcggtctattttccaatagattacgcggaaaaaagcggcattaattgccgcttggtattttggtcttatttcgtaccaaaaatcttatcacctgcatcacccaaccctgggataatgtagccatgctcatttaaatggctatcaattgatgcagtatataattcaacatcaggatgtacagcctctaaagctttgatcccttcaggtgcagcaactaagactaggactttaatatgctgacaaccttttgcttttaataaattaatagtcgcaatcatagaacccccagtggctaacataggatcaacaacaattgctaagcgttcatctaaatcacttgctaatttttgaaaataaggaactggttctagagtttcttcatcacgatacatacccactacactgatgcgggcacttggaacatgttccaatacgccgtccatcatacctaatccggcacgaagaataggaacgacagtgacttttttacccttaattcgatcaatttcaacagcaccacaccaaccatcaattatcactttttcagtttctaaatctgatgtggcttcataagtcaacaggcttcccacttcagtggctaattcacggaaatcttttgtagtaatatctgcaactcgcatcaaacctagtttatgttttactagtggatgtttaacttcaacaattttcatcgcatgcttccttattgatcgattatgtaaaaaaaatccaaacggcggaattctaaatgatcttgattaaaattaatagtattgaaagaatgttttaataaaaaactgcaatatgcagatgcagaatatttattttaccttaggcaaactgttgcatgcctagagtgccgtcatcaataatttcagactctatgcctaagatttctgctactttatcaccttctttaaacatcacaaaaccgccagattccattttattccaatgttcatctttggtaagtgggaacgttgtaataattgttactttatctgtttcttttgcatagtcacgaaaatcaataatattatcatcgtctatgcgttgtgcttttccgaaaggtgccttacgagtgagatagtgtaaatttgttgaacagtgggccatcatccactcaccattagataggataaaattaaatgtgcctctctgtgttaattcttgtgtgagtttttgaattgcactaaacatatcttgttcattaggctttttgggaaaacgtttctttagttggctaagcatataacaaaatgctgtttcggaatccgtcgagcctatcggttgaaaaagactttctgtcatatcgggtaatgaatttaagttgccattatgagcaaaaacccaattttctccccaaagttcacgaataaaagggtgagtattttcaatattgacctctccttgtgttgctttacgaatatgtgcaacaacatttaaagattttatgttgtattgtttaatacaatcagcaatgggagaagaatgtccgggacgattgtcgcgaaaaacacgaattccttttccctcaaaaaaggcaattccgaaaccatcggaatggcaattagttaatcctgctcttcgacgaaatccctcaaatgaaaaaacaatatctgttggggtattacaattcattcctaaaagttgacacataatttatttcatttaacccaattttatgtctttttatctacacaatgagtatgaatttaacaaaaatacagattaaaaatcaacatggatcttagatcaattagttacataaaatagctaaaaaaacttaccgcaccaagttttcacaaggtgcggtaagcaaataagaaggtttaatataaaatgataaggattagtaaacaccttgtgctaacattgcatcagctactttaacaaagcctgcaacgtttgcacctacaacatagttaatatttttttgcccttcgacagtaccgtattttttacaatttgcatgaatatccaacataatacggtgtaatttttcgtcaacttcctcagctgtccagtataaacgttgtgagctttgtgccatttccaaaccggaagttgcaacgccaccggcatttgccgccttaccaggtccaaataaaacgcctgcttccaagaatgcgtcggtagcttcaattgttgttggcatattggcaccttctgcaacaagttgaaccccgttggcgatcaattgttgtgcatcggataattccaattcattttgggttgcacaaggtagtgcaatatccgctttcactccccaaggacgagctccctccacgtattgcaaaccaaattgttcagcgtaatctttaacacgaccacgttttacatttttaatatctaaaagtgcggtcaatttttcttgtgtaaagccttcaggatcataaacatagccggagctatcagaacaagtgacaacttttgcccctaactgcaaggctttttcgatagcatattgagcaacgttacctgaaccggaaactacaactgttttccctgcgaaagattgtcctttttcagcaagcatagcttgagcaaaataaactaaaccataacctgttgcttccggacgaattaaactgccaccaaatgacaaacctcgaccggtaaacacgcaagctgcttggttagataattttttcatatatcctgcaagataacctacttctcgtccacctacaccgatatcacctgccggtacatcggtatctgcaccgacatgacgatataattcagccattaatgcttgacaaaaacgcatgacttccgcatctgatttacccttaggatcaaaatcggaaccacctttaccaccccccattggtaaggtagttaaagcatttttgaaaatttgctcaaagcctaaaaattttaaaatagataaatttacagatggatgaaaacgcattccacctttaaacggtccaatcgcactattgaattgaactcggaatgctcggtttacttgcacttgacctttatcatctgtccaagcgacacgaaattgaaatgcacgttccggctcaactaaacgctccaataaagcttcagagcgatattttggatttttctctaaaaatggccaaatggaagtgaatacttcacgtactgcttgcaaaaattctggttgatgaccgtcacgttgttctacttttgctaaaaaatcttctaacgatacgattgctgacataatttgtttccttcttaattgaaatgttttgtttgcttatttatatagagagcctttatcagcccacgattaatatgcaataaaatatcaaaacattgcaactaaaattattaaaaaaaattaaaaaactatttaaatattaaattttatttaaaataattgtatatattttaaatttattttgattttagttgggttaatagaagtaatatcaaaaagcaggaggaaaaaactaccgcacttatatattctaaattgaagaatttacagcaaaataaaaactggagactatgtttatctttatatgttaagtaaaaaatgtaaatattagtttcattttgaagaaatttattacacactatatgggcaaattattttgcaactatttttactttaggagttattatgaaaaaagcactattaacagcattagtattaggcacgagtttaactgttactggttgttttgataaagacaacaacgtttctcagcaagcagaaagtacaaaagaaagtgtatcaacagcaattgctgaaacaaaagaagctatgtcagaacaagtaacggaagttaaagagacagcagctgaaaaagttgaagtagctaaagaagctatgtcagaacaagtaacggaaattaaagagacagcagctgagaaagttgaagcagctaaagaagctatgtcagaacaagtaacggaanttaaagagacagcagctgaraaagttgaagcagctaaagaagctatgtcagaacaagtaacggaagttaaagagatggcgactgaaaaagtggaagcggctaaagaagctatgtcagaacaagtaacggaagttaaagagatggcgactgaaaaagtggaagcggctaaagaagctatgtcagaacaagtaacggaagttaaagagatggcggctgaaaaagttgaagcagctaaagaagctatgtcagaaaaagtaatggaagttaaagagatggcgactgagataaaaagtgcagtagaaaaatagtctatattgggttagattttctttaatgattagagctagaatgattgttttctagccttttttctttataaattgagattaagtttgtctttttatccaaatttgttagaatcagtcagaattttggggctgattttggattcgacggaattagcgaagcccaaggtgcacgtcgaggtgcggtaggcctcgtaaataaaccgcaaaacaatagtcgcaaacgacgaacaatacgctttagcagcttaataacctgctcatagccttcactccctagctttcgctcgtaagacggggataaagtggagtcaaatccaaacgagatcgtgttgaagccgccgctttaggatcgaagcattaaattgaataaagctagttttttgatggcgtgtctgtccgcagtcaatttacgaaattaaagattagactaaacgtgtaggactgaaggtagagtaatttcggacgggggttcaactccccccagctccaccatatcattcgaaaagaaaatttctagacattttgaaccgcattgaaaatgccaattttggcgtaactttttgtttttaatctttttagtgaaatttgttaacaacttaattttattaacaaaatttatttggcttttagaaggtttacggcacatcttgttaagatgttaaagaaaaaccgaaagaaaaacatttactaattgatggctaagggttgttctgaaaaactaagtttggcgatgttaaaatttgactaattaactctattagaagctagttatatcataactagcttctcgtttttatctccaaattaaattactttttcttgtaattgtagtttggaatagcggtccagcgttttttgaattctttaacgacttgttttggttgacgattgcgtgagaaaagccctttatggtttccttgtatacggtaaatcataaggtttgtttcaaagtctgcaaaattccatacttgttccccaacaagattagggatgctgtcaaaaacactatggctcatagcataaaaatcacattgaaactcttcggtataaggaatatcccacatagaatgtaagccaggtaaagtatctgcaccatattctgtcataagaattggtttatctgggaatttactttgccattttaacaactcttgacgaagtccagcttctcctttagctaaatcaccatgatctacataccaagcatagtatcgattcaaagaaatgacatctaccaaatccattacttcatcacgctctggcgttgccagtaaaatattgactaaggtaacaggacgtttttgcggatccaattccttataaagagcaactaatggtttgaaataatcatgagcacctgcttcatggctggctggttcatttgctactacccacatgacaactgaagggtgatttttatcacgttttaccaattcttgaatcgcttgttcatgtgcttctcgggttttcatagcagaccaagtgccgttatctttgggatttaaatcaagagaagcggtaaagttttggaaaagtccaacggctggaatttcatcaattaccaaaactcccatgcgatctgcaagacgcatcatttcttcagaataaggatagtgtgaggttcggaaagagttggcaccaatttctttcaaaaggttcatatccatcaagtttgctgcttcgtttaaacctcgaccattgataaaggtatcttcatgttttccaaaacctttaaaataaacaggtttttgattgacaaagaattgaccatctgccacatgaacactacgtacaccaaatggctcatcataggtatcaacaactttaccatcaacaagtagctcaatatgtgcggtataaagataagcatctaaaacttcccataagcgtacttgttcgagagtgatatgcccgttacttgattgtgcaactacttgacgatcttcatcaagaatagttacttggattgtgtcaactgcctttgatgtttcaacagcaatagaaagttttgccgtctttaagtcatctgaaagctcactgacgatggtaacatctgaaatgtgaattttaggacgtaccattaattttactgggcgatgaattcctgcatagttgaagaagtcaaagttttctttaaccacttttttaatactgccatcttcttgagtctcttcaatgtaattaccaacaggaagtgtggtgtaatctaagatattattggcacagacagagatttttatttgattttcttggtaaagatcctctggaataattacctcaaacggagtgaatccacctttatgagaagcaagttctcgaccgttaacataaattttggcattgtgagttaccgaaccaaagcgtaaaactaactcatcattttccgctaatttgggaatatccacccaacgctcataccaaaaatctccaatataattacgcttatctttgtcaaccaccacgtcattaaaggaagttggtactaccattacttcttctggtgataaatccttttcgggattatgctctcctagtttaaattgccataaaccactaaggtcatataaacttcttgtttttgttaacgttggatataacatatattttctcctttgtgtttcttaacgtttaatctcgtgggaagtctcatctagcaattgatcaatatctgcttgagaaatcacattaatatcgccttcaatggtgtgtttgaacttgaaacttgccatagcaatggccaaacttttttcaggactttcttttttaagcatgccatgaataattcccgctgtaaaagcgtctccagtaccaacacggtctaacacttgaatgcctgatttgtctgtctgataaagatgaccatcctgatataaatagcctttcaatagatattcattagtatgtcccatttctctttgagtaaaagcaaagcttttcacgctataagttttagctaatttatccaaaatgctttttaataattcttgatcttcgtaaggtcttgttaaacctaattggtcttttaaatctccttgcccatcaccggaaagacttaacggctcaattccaatgcaaacatctgctagagcggcaagaggggacaataattctcttgcctcttggaaagagttccataaacttgctctaaaatttaaatcaaaagagacagtgagtccctctgctttagccttggtcatcaaataatgggttaagctataaaggttatcattcaacgctggagtgatgccagacacatgaaaccagtcggctcctttgaatacagactctaggtcataatcactcagttgagattcccaaaaagcagagtgttttcggtcataagttacccgactggcacgtaaggaaaagcctttctggtaataataaatccctagacgttgccctttttccaaaatgtaatcctgattgatttgacgagaaaaaagaaagtttttcgtcatcctacctaaatcattatccggaatggcagatataagagaaacgttgtgtcctaattgtgccaaggttgaaagaacatttaattctgaaccgccaaattgacattctagactggttgtcagtgttagggtttgatactgtggtggtgataaccgtaacaagatttcacctaaagaaactactgttttcaactaaaacctccatcttgatgggttgtgctaaaagtagtatacacgatattatgttttttagtacaagaaagtgggctacagtaaaaaataagttatatcatcatcgtaacagactgcttatttagaattcttaatatctattagattattagattgttattcgcattgatttgtcgataatcttcaatgcagtgatgttttaaaaaaacaagcatattctctttataagatgtttagaaaaatctcttttgttttttgtcgtgtggagtgacaaaagtgcggtgtcttttggtgtgtccttagaaatactttacaagtgttgattaaataagttcaaagatagccagcaaaagaattattttagaaatgcagtaaaaattatcatttatgccatagaaatattaacagaaattagtaatttaaattgagattaacgacagaaaatagtaaagtagcccactattcattcacttacaaaaatagcttttaaggcggaatttatgggaaaaagtgttgttgttttaggtgctcaatggggcgatgaagggaaaggcaaaatcgttgatttattaacagatcgagttaagtatgtggttcgctatcaaggtgggcataatgcggggcatacattgattattaatggtgaaaaaacagttcttagattaattccatcaggtatattacgtgaaaacgtaacctgtctgattggaaatggggttgttctttcaccgacagccttaatgcaagaaatgggggaattagaaagtcgtgggattaatgttcgtgaacgtttgttaatttccgaggcttgtccgttaattcttccttaccatgttgcaatggataaagctcgtgagtcagctttaggcaataaagcaatcggtaccacaggacgtggtattggtccggcttatgaagataaagtcgctcgtagaggcttacgtgttggcgatttgtttgataaacaatcattcgccgaaaaattaaaaaatattctagattactataattttcagttagttaattattacaaggttgaggctgttgattatcaaaaaacgttggatgaagtacttgcagtggcagatattatcacagctatggttgcagatgtgacgacaattttagacgttgctcgtaaaaatggcgataacattttatttgaaggtgctcaaggcacaatgttggatattgaccaaggcacatatccttatgtaaccagttctaacacaactgctggtggtgtatccactggagcaggttttggtcctcgtcatattgattatgttttaggtattattaaagcctattgtactcgtgttggtgggggaccattcacaacagaattatttgatgaagtgggagcggaaattgcacggaaaggaaatgaatttggtgccgtaaccggtcgaccacgtcgttgcggttggtttgatgctgttgctattaagcgagcaatccaaacgaattctatttccggtttttgtatgaccaagctggacgtattagatggatttcgtgaagtcaaaatttgtgttggctacaaaatgcctaatggtgaaattgctgaatatgcaccattagcggcaaaagattgggaaggtgtagagccgatttatgaaaccttaccgggttggcaagaaaatacatttggtataacagatgttaatcagttaccggaaaatactcgtaattacattaaacgtattgaggaagttacgggcgtacctatcgcgattctttcgacaggtcctgatcgtgttgaaactatgattttaaacgatccttttgcggtgtaaatcataaataatagagacaaaagtggtttaattcagaaatgaattaagccacttttttatctcaatcaacttcctgaaatcttcattttttccaacaaaatcgaacctgtttgaatattcgatctatattcaatatcgttaccaaccgcaataatatttgcaaacatgtcttttaattgcccggcaatagtgatctccgatacaggatattgaatttcaccattttcaacccaaaatccaaaagctccacgtgaataatcaccggtaataatattaaccccttgtcccattaaatcagtgaccaataaacctgttcccatttcttgtaaaagtgcggttaaattttgtgaatttggcttaaccagccagttatgaattccacctgcatgtcctgtactttgcatacctaattttcgaccgctataacttgtcagcaaataggtttgtaaaataccttgttcgataatttctaaatttttcgtacgaacaccttcaccatcaaaaggtgttgaagcaagtttgccaatcaaatgcggtctttcactaatatgaaaccaatcaggtaatatttttttacccaaatgatcaagtaaaaaactcgagttacgatataaacttccaccgctaatcgctgttgccaaatgtcctatcaggccggttgccacactattcatgaaaataaccggtgcttcttgagttggaatttttctcggttgtaaatgagatagtgcttttttggcagaattttcgccaacccaaaccgcactttccaactcttgaatattacgtgcaacagtatattcataatctcgctcaagttgttcgttgctgcttgcaatcacagaacaagataaagaataacgacttgataaatagctttgtaacatgccgtggctattaccataaactcgcacaccggtatgcgaattaaatgttgcaccttcactgtttacaatgcgtttatcataatctaaagcggctttctctgtttgcaaagccaatgaaacggcatgatcaacatcaatatcaaactcatgataaagtgctaaatccggtgcatcaaatgccattaattccttatcagctaaccctgcacaatcatccggagaggtatatttcgcaatagctaaggcggaatctaccgcactttttattgcggtatggcttaaatccgaagttgaggcatttcctttttgattccccaaataaacggaaatacctaaagcaccatcattgttaaattctacattttcaatttcctgtaaacgagttgaaacggataaaccattgacttttgtaactgcaacttctgctgttgcacctgcttgcgtagcagtttcaattgcatagcttacagcatcttgtaacatttgctcttgttgctttaaaagtgcggtggaattttgttgagttatcattataagcctttttattaaacagaaattttggctattttagcttattttcaaatttgtcgctaaccacaaatactatgtcatttcggcaaaatgtgaagttatgctaaaatacgccgaattttacataaggaaaataggaataaatcatggcgaaatgtaaagaagaagtgtttaattgggaagatgaggaacaagaagaaattatttgggtgagtaaaagtgaaataaaacgtgatgcggaagctttgaaaaaattaggtgaaaaactcgtcaatttaaccaaaacaaatttggataaaataccattagacacagggttgcgtgatgcggtcgaacttgcacaacgtttgcaaaaagaagctcttcgccgtcaaattcaatatatcggcaaactcttgcgagccattgatccggaaccaatccaagaagcgttaaataaaattgaaaataaacatcagcagcaacaagcaatattacataaattagaattattacgagatgaattggttcaaaaaggtaacagtgcatttacagagctattaatacagtatcctcatgcagatcgccaacatttacataacctaattcgttcagcacaaaaagagcgggaacaaaacaaaccgcctaaatcataccgagaaattttccaatatttgaaagatctgattttggaagattaacatgaaaatccgcatgttaaagtgcattaacgtttatctgctatttttcacatgtaccaaaatccgctataatggcggacatttttgatataacgtacctaataatgtaaaaaaaccaaagaggtttattatgactactccagtagttgctctagtcggtcgccctaatgtcggtaaatcgactttatttaatcgtctaacacgtactcgtgatgctttagtggctgattttcccggtcttactcgggatcgaaaatatggtcaagcacatttcaatggttatgactttattgtgattgatacgggaggtattgatgggacggaagaaggcgtagaggaaaaaatggcggagcaatccttacttgccattgaagaagccgatattgttttatttcttgtagatgctcgtgctggcttaacttctgcggatgttggtattgctcaatatttgcgtaaacgccaaaataaaactactgtacttgtggcaaacaaaaccgatggtattgatgcagattctcattgtgcagagttttatcaactaggcttgggtgaaattgaaaaaattgcggcatcacaaggacgcggtataagtgcattaatggaaaaagttttgccacctgttgccgacaagctaagtttagctaacgcagaagagcattcagaaagtgcggtagaaaattcagatgaaagtgcggaagaatgggaaaaagattttaattttaatagcgaagaagatatacagctacttgatgaggctcttgtagaagaacaagaagaaagtgaagataaaaatatcaaaattgccattgtgggtcgtccaaatgtaggaaaatcaacactaactaaccgcattttaggtgaagatcgtgtagtggtgtatgacttaccggggaccactcgagacagcatttatattccaatggagcgagatggtcagcaatacactctcattgatacggccggtgtacgcaaacgtggtaaagttcatttaacagtagaaaaattctctgttatcaaaacattacaagctattcaagatgcgaatgttattttgttgacgattgatgctcgtcaaggcatatccgatcaagatttatcgttattaggtttcattttaaataccggtcgttccttggtcattgttgtcaataaatgggacggtttaaatcaagatataaaagatcaagtcaaatctgaattggatcgtcgtttagactttattgattttgcacgtgttcattttatttctgctctacatggtagtggtgtaggcaatttatttgacagtataaaagaggcttatgcttgtgctacaaaaaaaatgacaacatcattactaacccgcattctacaaatggcaacagatgaacatcaaccgccaatgataggtgggcgtagaattaaactaaaatatgcacatccaggcgggtataatccaccaattattgttgtacacggcaatcaaatcgaaggtttgccggacagctacaaacgatatttatctaactattaccgtcgtagcttaaaaattattggatcaccgattcgtttattgttccaagaaggaaacaacccgttcgcagggcgtcgtaataaactgacaccaaatcagttgcgtaaacgtaaacgtttgatgaaatttatcaaaaaatcaaaacagcgataaatataatataaatgggcggaaaatatccgcccaaaatcactgcactttgcctctatattttttcttattttgcgatctctctcgcaaatatttcccaattcaataaactttcaactttttatcttttatattaaagcctttccacacaaacggatataaggataattatgcgagtattagcactattttttatgttgttcattataaaagttcaagcaacattgccggatttcatgctgttggaaaactataaaaatcaggacgtaagcggttgggtgatgagtgaaaagttggatggcattaggggatattgggatggtaaacaacttttcactcgacaaaataaagtcattcagccaccgcactattttattcgtgatttcccaccctttgctattgacggcgaactttttaccgaacgtaatcaattcgaaaaaatatcctctattgtacgttccaaaaaagataaaggttgggaaaaaatgaaattatatgtttttgatgttcccaatgcacaaggaaatttatttgaaagactggctgttttacaagattatcttgataaacatcctacaccttatattcaaattattgagcaaattcccattaaaactaaacaacaagtgaaaaattttttacaacaaattgaaaaacagcaaggtgagggagttgttttacgtaatcctcatgctacctatgaacgaaaacgcagtacacaaattttgaaattaaagaccgcacttgatgaagaatgtactgttatagctcatcatcaaggtaaaggacaatttgaaaatatgctaggatcaatcagctgtcaaaatcatcgtggcatttttaaaatcggctcaggatttaatttaattgaacgtagaaatccgcctccaataggctctattattacctataaatatcgtggattaactaaaaatggacttcctcgatttgccacttattggcgttcaaagaaagaataaaagtgcggtgatgattgatataaaatcttcttatggggctgatattttcctttacaagccgtaaaatctgcctaaaataaagcccccaaatagcttgcatagtcaagctactgacttgtaatcagacttaagagaaaatttatgacaactcaattcaaaccggaattattatctccagccggttcgttaaaaaatatgcgttatgcttttgcttatggtgcagatgccgtatatgccggtcaacctcgatatagtttgcgagttcgcaacaatgaatttaatcatgctaatttaaaaatcggtattgatgaagcacatgcacttggtaaaaaattctatgttgtagtgaatattgcaccacataattctaaattaaaaacctttatcaaagatttacaacccgtgattgatatgcaacctgatgcactaatcatgtcagaccctggcttgattatgttggtgcgtgagcatttcccaaatattgatattcatctttctgtacaagcaaatgcagtgaattgggcgacagtgaaattctggaaacaattgggtttaactcgagtgattctatctcgtgaactctccttggaagaaatcgctgaaattcgccagcaagtaccggatattgaagttgaaatatttgtgcatggtgctttatgtatggcatattcaggacgctgtttattatcaggctatattaacaagcgtgatcccaatcaaggtacttgtaccaatgcctgtcgctgggaatattctgttgtagaaggaaaaacagatgaagtaggcaacattgtgaatgttggtgaagaaattcccgttaaaaatgtcgcaccgacgttaggtgaaggaaatacaacaaataaagtctttttattagcggaaaatcagcgacctgaagagcaaatgtcagcctttgaagatgagcatggtacttatattatgaactctaaagatctgcgtgcagtgcaacatgtagaaaaactttcacaaattggtgttcattctttaaaaattgaagggcgtacaaaatctttctattattgtgcaaggacggctcaagtttatcgcaaggctattgatgacgcagtagcaggcagaccttttgatgaaagtttaatggatacattggaaagtttggcacatcgtggctatacagaaggtttcttacgccgtcatacgcatgatgaataccaaaattatgattatgggtattctatttctgaacgccaacaatttgtcggagaatttaccggtaaacgtaatgaacaaggtatggcggaagttgcggttaaaaataaattcttgttaggtgatgaagttgaattaatgacgcccaaaggcaatgtggtttttaccattgagcgtatgcttaatcgtaaaaatgaacacattgatgccgcacttggtgatgggcattttgtttttttagatgttcctcaagatattcaacttgattatgcgttactcatgcgtaatttagttaatgcaaatacaagaaatccgcataataaaaaataatcgtttgttagaaattttttgtgaatgtaaaaaatatttcgccctttcttgatgaaagggcttttttaccctctgtttatatcacctaatttatcagacagtgctatcgggcaacgcaagtgctatacccgtagcacttgccgattgccttagtcttgtagcactaagggggtgatttatgttctaaccattcttgacctaatcgcttatctagtaactagattgtcctaagacaatcggaaggggtgagatggtaactcgccccgacctattcccattgtatgccctatcccctgatttttcaagttatctacttttcaaataatcttattcttaattcgtctagagttttaatttctccagaaacatattttttcagtaatacttcacattctttagatggatattccccttctaatgcaaaactggctaaggcgttttttatatgaaattcccgtctagttaaaatttcaggtgttaatttttcatcatcttgcataaatccccctaaaatttatatttatgaaatttttttctcactaacttagaaagttcttcgtagtcaatttcttctggtttaagagcgtatagcttgttacgcaagccggctaataactcgctatcttcgtttctaccacctgtttgagccacgattaagccgagtgtttgggaaatgccattgattaaactgtctttttccatgagtgttgccataattctcccccttgttttatttgaaaaacctttaaaaataaccacttttatttgccaaagcaccattagaacatttattaaatcaatctggcgtgattttttgtcaagaaaaaattgcttttgatcacgtaaaaagcggaaccattaatgatagcaattattttgtttattatggcaaagtagcatcattggaacaacattttcaattgcaaggcaaaaattatacttgctacgctttttctaatcctccttacccttttgttagaccagcaatttttgatgatgaactcaattttttagagcaagcactctcaaataaaaacaaaattgataaaaagaaagcttttgtattttttaaacgttatgccaatcaaccgatttgtgttggaaacttccttcaaaaactatcctatctcctctattttcgttggggcagtcataacattattggcaactttgattttttctgcactggcatggctcattagttccattattttcttctggcaacaacacaaaattccctctgagtatcgacaaaaaatgcgtaaccgagaaccatttcaacgcttatcgaaaattgtgcctcttgttttttaggtgcgggtatttatggtgcggtcgccgctcacgatattctgccaaaatggaacggatttccacaacctcaaatccaacaactttctacgcagtattgctcagccaattggtgccaaaatctttccaaaatcaacatcaaaacaaggacgctaccagctggagtttatagtgcggaagaaaaaacgcgtattattcaaaaaaccttagtcaaaaaaggttacaaacttaaagtggacggaaaatttggtgcaaaaactcgcaatgccgcagtaagttaccttgcgaccaaaggtatcagcgtcactaacgatatcgccttggatcggttgtttgagtattttgaaccaaacttacagtaaaatacattattttgaagtattgtatattgatagaatgtttattctaatatatagctttttgtatgacttaaactctttttaacgtgcctatttctttgctttaattacagatgttcttgtatattatagtttttcatatctgtgatatttatcacaaaaacgaaataaaaattccaaattttaataaaaatgaaaattttgcattgaaataaaagtagcaatattgtattaatatcaaggtatttaagtggttcaatattacagtctgatcactaaatagagaagttcattgctaaatttaatatttacatatgctaaaattgataggaaaattctatgaaaactgcaaaaaactgcaaaaaactgcaaaaaactgcaaaaaactgcaaaaaactgcaaaaaactgcaaaaaactgcaaaaaactgcaaaaaactgcatagcattcttttaactacgctacttatctcccttcctgtactatcacaagctaaaaccctaagattggctcatcatatggctaatgataatgttaaccatacactagttatagatttttcagacaaactcaaagaaatatctaatggaaaacttactgttgatgtttactcaaacgggattttaggcgatcaagtggagctatttgaaggaatgaagcttggcaccgttgatatgtccatctcagatactagcatcattgcttcttattattctccaattgggattttagatatgccttatttttttaaggatatggagcatattaaaaaattactaaatacagccaaaatggcagaaattaaaaaacaagttgaagccaaatcaggggttaaaatattaagtattcaacctgtcgcttatagaaatattattcttaaaaaagaacttgctgataataataaatttgatggcttaaaaattcgagtaccaaattctcctgtacttgttaataccataacttctcttggagctacaccaagtccaattccatcaggtgaggcatacactgctatccaaacaggagttgtggatggtatggaaggtaatccggaatttttaagctccattaaaatcagcgaagtagctaaaaactggtatgagacacaacatgccatgacttttactgcgttaaatattagtgctaaaaaatttaattcattaacagaatctgaacaacaatggattaaagaggctgtaacttttgcaatagatcagttttatattaagactgtcaacactgatgaaaaatggagaagttatctaaaacaacaaggtgtcgagtttcataatgtagatataccaactctaagagaaaaagctaaaccaatggttgataaatttgttcaagcaaacggattagaagaattatataaagaggcacaaaaatgaaactagatggttatatttcctcatttagaaatacattaacgattatacttttttctgcacttgtcattgttgtatctataggtgtgttttctagatttttaacatcacatcctttcgcttggactgaagaactgtctagatttatttttatttggttagcttggatagcttcaagtttaacaattgctaagggtattaatattacctttgatattgtgctggataaattagaacaaaccgttggtaatattgctcatattattgtgaatgttatttctgtcatttacatactcgcagtcattatattgggatacatactttgtattaataatacaaattcatattcccctttactcggtgttccaatgtggactctaaatcttgcgatacctgttggtggggtattgatggtttatgagcaaattaaaaatttaatcaagaaacgttaattataatgaggtgatatatgctacttcttgcattcttatgcttctttattttggttctgctcggtgtgcctattgcattttcaatgggattaggtgccataatttcaattctgtctaatgatttaccgttagcattgatttctcagcgtttattctcaggtataaattccttttcattattagcaattccgttttttatgttagctggagaattaatggagaatggaggaatatccagaagacttattcatttatcgaaatgtttagtcggacattttagaggcggtctaggtatgatagatatatccacctctgtaatttttgccggagtatcaggatctgcagctgcagatacagccgccgtcggttcaattatgatacctaccatgaaaaaaaatggctatccagcaggcttaactgcagtccttcaatctgtagcaggatctcttggtccaattattccacctagcttaactgcgattatttttgcctcattaactggattatcaattaaagatttatttttagcagggattttacctggaattgctatagctatcggattggttctagtcacctatttctatgctaaaaaatataatcttggtagagatcaaaaggcatctagagccattttatgcaaagcatttaaagaggcgtcttctgcattatttatgccggttatcatagtaggtggaattttggttggcttctttacgccaactgaagctggggctgtagcagtactttatgctattgcagtcggtatttattataaagaattaacttttaaaaaattcaaacattcaatactaaatgcagccgcaatgaccgcaatgtgtaccctaattatatcgggagcaactattttatcatggattatcgccttcactcgtttgcctgatttaattatagggttcttaacaagtattacggataatccttacatgatccttctgctcttagtagcatttttattatttatcggcatgtttattgaaactattgccgcaactattattgttgcaccaattttaatgccagtagcttatcaatatggaatagatccgatacaatttgccataattatgatcgtggtcttagtttatgcaggtgtaacacctcctgtcggtggagtattgttcattaccatggggattgctaatgtcaaactacaggaaacgctaaaatacctcgttccttatttaggtgtcatattcatcgttgtgttactgatgatattattcccttcgatctctttgatgatacctaatatgttccgttaaaaaacaagtgagtataatgtgtttttcattttactcacttgatggcgataatgacacaatttcctcttgtatgaacccatatttgcgactagactacgcccttacagtttttattatgattttacgaagttatgtatttatctgatttctattttgacttacctgatgaattaattgcacgttatcccaaacgtgagcgttcttccagtcgtatgttgcaattaaacggacaaaacggagaattatttcaccgcacttttagcgatgttgcagatctgattaacgaaggcgatttgctgatttttaataatacccgagtgattccggcgagaatgtttgggcgaaaagcaagcggtggaaaaatagaagtgttggttgagcgggtactaaatgaacatcattttttagcccatattcgatcttcaaaatcaccgaaagaaaatacaatgctttttttaggtgaagataagttgggagaagggaagggtgttgaaatgctgatgaaggcacgccatgaaaatttatttgaactggaattaagtgataaaagtaccgctcttttagatattttacagaaaataggtcatatgcctttacccccttatattgatcgtccagatgaagatgccgataaggaacgctatcagacggtctacaataaagttccgggggctgtggctgcaccaactgccggcttacattttgatgatgagctattgacacaactcaaaaacaagggggttaattttgcctttgttaccttacatgtcggtgccggcactttccaacctgttcgtgtagaaaatattgaagatcataaaatgcacgcagaatatgtggaagtcccgcaagaagtggttgatgctgttttagccacaaaagcaaagggtaaacgagttattgcagtaggtacaacttctgtacggtcaattgaaagtgcggcactttttgccgaagaaaataatagcactcatttacttgaaccctatttttccgacacttccatttttatttatccgggcaaaaaatttcgtgttattgactgtttgattaccaatttccatttgccggagagtactttgattatgctggtttctgcttttgccggttatcaacatacgatgaatgcttataaaagtgcggtcgaaaatcgctatcgcttttttagctatggcgatgccatgtttattacgaaggcctaaaagccgattacatcagactgtttatctgacgagaaggattacaaatgacaatgaaatttaccttacataaaactaacggtatggcacgtcgaggtaccatgacttttaatcgtccgcagggcgaatttacggtggaaacgccagcttttatgccggttggaacctatggcacggtaaagggcatgacacctgaagaagtgcgggcaacaggggcagaaattttactgggaaatacctttcatttgtggcttcgcccgggtcaagaaattatgcgtcaacacggtgatttacacgattttatgcaatggcatcgtccaattttaaccgatagtggtggttttcaagtttttagcttaggtaaattgcgtaaaattactgaagaaggtgttaaatttcaaaatccaattaatggcgaaagaattttcttatcaccggaaaaatctatggaaattcaatatgatttaggttcggacatcgtgatgattttcgatgaatgtacaccttatccggcaactttcgattatgccaaaaaatccatggaaatgtctttacgttgggcaaagcgtagtcgtgaacgttttgatgaattaggtaataaaaatgccttgttcggtattgtacaaggcagtacttttgaagatttacgtaaactttctattgaggggttaattaatatcggttttgacggctatgctgttggtggattagctgttggagaacctaaagaagatatgcacagaattttagcatatgtttgcccgcaacttccggcggataaacctcgttatttaatgggtgtcggtaaaccggaagatttggttgaaggtgttcggcgtggtattgatatgtttgattgcgttatgccaactcgtaatgctcgtaacggtcatctttttgtcagtaacggtattgtaaaaattcgtaatgcaaaatatcgtaatgacacaacctcccttgatcctgaatgtgattgctatacctgtaaacactataccaaagcttatttatatcatctggataagtgcggtgaaattttgggggcgagattaaataccattcataatcttcgctattatcaacgtttaatggctcaaattcgtcaagcgattgaagaagatcgttttgaggattttgttgtagaattttataaaaaaatcggtaaatctgtgcctgcacgataagaaagtaataataattgtcggagaaataacctacaaggtcggttattgataaataaagtgcggtgaaataaaaagatattttcacattaaaagaattttatgctattttacgcaagtttttaatgaatgtttaactcacttataaggataaaataatggaagctcaacaaagtagcccactttctatgttatttatttttgccatttttggattgattttctattttatgatctatcgtccacaagcaaaacgtagcaaagcacataagcagttaatgtctgaattagcgaaaggcactgaggtgttaacttcaggtggtattatcggtaaaatcagcaaaatcagtgctgaaaacgattatgtcgttatcgcattaaatgatacgactgaaatcactatcaaacgcgattttatcgtagccgtattgccaaaaggttctttaaaatctatctaaattttcattcattccgcaagggaacaagtctatgttaaatcgttaccctttatggaagaatctaatggtgatcctagtgatcgccattggtgttttatattctcttccaaatctttacggtgaagatccagctgtacaaatctctggaacacgagggcaaaccgctgatataaacgtgcttactaatgtacaaacattattagagcaaaataatttacctatcaaatcaattattttggaaaacggctcaattttagctcgtttcaacaatacagatgatcaacttttagctaaagataaaattattgaacaacttggtaataattattccgttgcacttaaccttgcacccgccacaccaaaatggttaaccaatattggcggtagaccgatgaaatgggggttagacctacggggaggtgttcgtttcttaatggaagtggatatgcacactgcattggataaacgccaagaacaattacaagacagcttacgtaccgaattacgcaaagaaaaatatcaatatacgtctattcgtaatggagaaaattttacaactctcattaccttagctaaaccggaacaactttccgatgtacaacgtttcttgcgtaaacaacatcaaaatctgaacgttaatgccatttctgaaaacacactaagtttagaattatcagagaacgctctaagagaaattcgtgatcatgctattgaacaaaacttaagtattttacgtcgtcgtgtagaagaattgggtgttgctgaacctgttattcagcgtcaaggggctgagcgtattgtagtggaattacccggtgtacaggatacagctcgggcaaaagaaattctaggtgcaacagcaacgctggaattccgtttagtaaatcaaaatgcaaatttagatgtcgctcttaaaggtatggtgccttctgattcggaagtgaaatatgatcgcaatggtagtcctattgtgttatatcgacgagctgtattaggcggtgagcatattactaatgcaagttcaggcatagatcaaaataccggttctcctcaggtttcggttactttagattctgaaggtggtgaaattatgtcacaaactaccaaacttaatctaaagaaaccaatggcaactctatatgtagaatataaagacagtggtaaaaaagacgaacatggtaaaactattttagctaaacatgaagaagttattaatgttgcgacaatccaaggtcgtttcggttcacaattccaaattaccggcatcaatagccctgctgaagcacaaaacctatcggtattactacgttcaggtgctttaactgcaccaattcaaattattgaagagagaacggtaggcccatctttgggggctcaaaatgttgaacaagggctgaaagcaggattatggggattagccattacgattatatttattctattttactataaactcttcggtttatttgccggcatagcccttattgccaatatgatacttcttgtaggtataatgtctttattacccggagcgactttaacaatgccgggtatcgcagggattgttttatctgtcggtatgtctgttgatgctaatgtattgatttttgaacgaataaaagaagaaattaataatggtcgcacaattcagcaagctattaatgaaggttatagcggtgcatttacgagtatttttgatgcgaacttaaccactattctaacatcagtcgtattatatgctgtaggtactggaccggttaaagggtttgctattacactctctttaggtgtagcgatttcaatgtttactgccattacaggaactcgttttcttgtaaacttaatctatggcggaaaacgtgttgaaaaattatcaatttaaggcaggtgaatagtgagtttatttacacgcaataaaaaagtgcatgaatataaaggggtcattttaccttttaaactaaccccttttatgaaataccgctactggggatatgctttctctatcattgtaactgcggtctgttttttctttatttttactaaaggattcaactggggactggattttaccggtggaacagtgatcgatacccatttttctcaaccagcagacctcaataaagtacgatctacattaaaagagaatggaatagaaagtgcgttggtacaaactacgggaagtgttcgagatgtcatgatcagattacctgtcgtagaaagtagtgctgaagtgggtaataaaattaaaactatcctcaatagtttggatgaaggtcttgaaattcatagtattgaatttgtaggtccgaatgttggtgaagaattaacacaaggtgcaatttacgcaacattagcaacattactgatgttattaggttatattgctttccgtttcgaatggcgtttaggtacaggagcagttattgcccttgctcatgatgttattgtcactttaggtgttttttcctacttccaaattgaaatggatcttaccttcgtggctgctatcctgtctgttgtaggatattcgcttaatgatagtatcgttgtttttgaccgagtgcgagaaaatttccgtaaaattcgccgtattgatactgttgaaattattgatatttcattgacccaaactttggcaaggacattaatgacatcaatcacaacattatttgtcgtaattgcactttttgctttcggtggaccaacaatccatagcttttcacttgcgttgttaatagggattgcttttggtacttattcaacgatttatattgcaattactctagctcttgatttagggctaaaacgtgaacatatgctaatccaaattgttgaaaaggaagagtttgaagaaggcttctaaactcatgttgtcgggcatttgcccgacatttagaaccaacaaatcaaaacactggaaactgtttaaaaaaataacaatgaaaaatgagtggtaggatttttcacaacaagagttgtttaacacgagtttttttggttcaaaacgttagtcatgtttttcttatgttattctcatcaaaaacctatctgtatcatcttaaggtcgaataaatcgaataagcaagcatagtaatcggtcaaaaagtgcctactgtcttgctttgaaaaaaaagattgtctttctcaatataacgtattgctatgtatagactctactacacgtttttttggtagacggtatgtattttaggcgtgaaaatttttagaagtatttggaggtaattctaaaatcttagttttggagagcaaacggaaaagacagaattattgaaattttaagtagcgattttggggattaacgaggtaactttttggtgctctgagcgagacttgaactcgcacgtcctacggacactaccccctcaagatagcgtgtctaccaattccaccaccagagcgtaatttgaatttaggtttttattgaggaatgtcgctgttttttgtgtcaggtgtcggtatgctttgttgtttttcctgaacttgctccgcaacttttgataaatcatcaaacttaccacttttaacattattgctatgtgaattgatattaccaatcaataaactgatagcaaaaaatgctgttgccaaaatggctgtcgtacgagataagaaattgcctgcacctgctgaaccaaaaactgttcctgaagcaccaccgccaaacgaagcccctgcattagcacctttaccttgttggattaagatgaaaccaatgaggacaatggcaataactaagtaagcgatcagtaaaacttggtacattatttcttctctctaaattcaaacatttctataaacaaaataacgtgcgaatactatctaatattggaaaccttcgcaagtggttttgataaaaattcggttaattgttttaatttcaggcaaaatttaaactgtgtttactcattttttttcaaatctgcttttttattctctttcgtttgaagtcctagtttccgcagtgcggaaaaattaaagtaacctaataattcaggtaaaagttcactgagcctttgcataaattgttgataggatccttgcctgcggctgatgctgtccagttgagcttcccaatgtgcggtcatatccggctgagttgcgatttctggtaaggcttgaatgagtgttctgcctgtttctgtactgtgaatattccgcccttttttatagatgaatcctcgcttaaataataattcaataatgcctgcccttgttgcttccgtacctaggccatctgtttcacgtaagatttttttcaattctttattttgtacaaaacgtgcgattcccgtcattgccgaaagtaaggttgcatcggtaaaaggttttggcggttgtgtttttttgctaattacatcacctttttcacaaaataattcatcaccttttttcacaataggaagcaaaggttcttgttgttcatcttcatcctcttttccccaaagttgtttccagcccgcaatttgtaaatttctcgcttgagcaataaaagttcccccagcaatatctaatgtaattttactttttcgatattcagcctcttgacaaaattgcattaagtattggcgagcaattaaatcatagatttgttgttcattttggcttaaagacacagttttattttttgccgttgggataatggcatgatgtgcttctacttttttatcgttccaacaacgatttttcagctcagtattaactatatcgggaatttctttatataaaatactgtgtgtggaaattgcacgtaaaatagtatgtcgtgcggaaaaatgttcttcaggcaaatagcgacaatcggaacgtgggtaagtgattaatttatgggtttcgtataatttttgacaaatatctaaaatttcttgtgcagacatggcataacgttttgccgcatctatttgtaatgcagaaagtgaataaggcaaaggggcggtttctttttctcttttatcaatatattctgtcaccgtcgctggttgtgcggtaatgcgttttacgacattttcggctaacgctttggataatactcgtccttcttcatcctgataatcttcacaggctttacttggttgccaaagtgcggtaaatgttgagggcgttttttcttttgttgcaataaaggcttgaacctcaaaaaaatctttcggttgaaaatgctcaatttctaaatcacgacgtacaattaatcccaagacaggtgtctgcactcggccaacggatagaacaccgttatagcctgattgacgaccacgaatagtgtaggctcgggtcatattaatgccatataaccaatctgctcttgaacgtgctaatgctgatgtagcaagggggataaaatttttgttaggctgtaatttttttattgctttttctaccgcacttggattgagatcgttaattagacaacgttgaatttcggctaattttgtagcaggcaacttggcataactgaaaacttcatcaactaataattgcccttctcgatccggatccccagcattaattataatgtctgcttgatgaattaatttaagtacaatgtccagctgactttttacttcttgtttgggaagtaatagccatttttgcggaataataggtaaatgttctaaacgccattgtttgaacattggattgtaaacatcaggagcagcttgttccaataaatgtcctacacaccaagttacataatcttgttcgccacatttgacaaagccttgtccacgttgatgcggtttaggcaatacgtcagcaatagctcgagcaaggctgggtttttccgctataaataatctcattagactactgattttagggattgatgaaagccgaatattctaacataaagtcaggctattccaaattcgctaaattttcgctaaaatgccttgcgttttttgattaacttagatggaagaaaattatgttcggaaaaggtggtttaggtaacttgatgaagcaagctcagcaaatgcaagagcggatgcaaaaaatgcaagaagaaattgcacaattagaagtaacaggcgaagccggagcgggtttaattaaggttacaatcaatggtgctcataactgtcgtcgtattgatattgatccttctttaatggaagacgataaagaaatgttagaagatcttattgcagcggcatttaacgatgcagtacgccgtgcagaagaaatgcaaaaagaaaaaatggcatccgttactgccggtatgtctttacctccgggatttaaaatgccgttttaaattaattcatatatgaccgggacgcaatgtttgcgtccgtttttttaataagataattcattatgcaaagcagtcctcttttagaaaatctgattgaacatttacgctgtttacccggcgttggtcctaaatccgcacagcgtatggcatatcatttattgcaacgtgatcgtagcggtggtatgaatttagctggtgctttaaccgaagcgatgtcgaaaattggtcattgtactcattgccgcacttttacggaagaagagagttgtgcaatttgtaataatccaagacgacaaaattcgggttttctttgtgttgtggaacagccttccgatattccagctattgagcaaacagggcaattttccgggcgatattttgtgttaatgggacatttatctcctttagatgggattggtccgaaagaaatcggtttggatttattgcaaaagcggttacaacatgaaagtttttatgaagttatcttagcaaccaatccaaccgttgaaggtgaggcaacagcgaattatattgcggaaatgtgttttcaacataatataaaggtcagccgtattgctcatggtatccctgtaggaggggaattggaaacagttgacggtacaactttaagtcattcacttattgggcgtcgtgaaattcaactataacatggttgacgtcttcccccgactttaggtggggaggatgtcaatccttattttattgttacacgtgcgaattttcgttttccgacttgataaactgcggtggaaggtgaaacaataagttttgcattgtcgactttttcaccattaattttgaccccaccttgctgcaccatacgaatagcctcagaagttgagccaacaagtccagcatcttttaataaattcgctaaaccgatttcgccggtaaaggtaaattccggcatgtcatcaggtattgcccctttttgaaaacgatcaataaattcttgttctgcagtatctgcatcatcagcactgtgaaagcgtgtaataatttcttttgcaagtaagattttgacatcacgtggattacgaccgttttcaacatccttttttaattgtgtaatttctgtgagcgggcggaatgacaacaggttataccaatcccacataagctcatcggaaattgacatgattttaccaaacatattacttggtgtttcggttacgccaatatagttaccgagagatttagacatttttttctcaccgtccaatccgactaataaaggcatagtaattgcaacttgaggtttttgtccgcaagatttttgtagctcacgccccattaataaattgaaggtttgatctgtaccgcctaactcgacatcggcttctaaatgtacggaatcatgaccttgtaaaaggggataaataaattcatgaatggcaatcggttgattattgttaaatcgttttttaaaatcatcacgttccaacattcttgcaacagtataattcgatgccaaacggatcattcctattgtacccaacttacctaaccaatctgaattgaatacaacttgtgttttttgtggatccaatattttgaaaatttgtgttttataagtttccgcattgcgtaacacatcttctcttgataaagggggacgagtagtattttttcctgaaggatcgcctactgttgcggtaaaatcgccgattagaaagattacttcatgaccaaagttctggaattggcgaagtttattaagtacaaccgtatgccctagatgaatatcgggtgccgttggatctgcacctaatttaatgcgtagcggacggttttctttgagtttttcaatgaaatcctgttctgaaaaaacatgatcaacaccacgtttcaattcggcaattacagtatttatattagtcattatgaatccttaatttgaataatattaataagttttttattttccttattatagggattattgattaaaagaaaagtccatagaatataaggttgtcgtaataattcatttttttctcggcgaccaaagtgcgaataaaaaaagcggtcaaaaagtatttccttttgaccacttatcttctattttaaagactagaatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttattgcaaatatttctcattcaaattttcacataaatcaagcgttaactcgttgggcaaggaaatctaatacctgctccttagcaattatttgtttttcacccgtacgacgatttttatattcaatttcgcctttttctaaatttttttcaccaataacaatcatatgaggaacacctatcaattccatatccgcaaacatcactccgggacgctcttttcgatcatcaaagataacatctacatttttattgagtaagctctgatacaattcttcagcaaaaatttgtacattttttgacttatacatattcattgggataattgccacagtgaacggtgcaatttcatcagaagaccaaataattcctttttcatcatggcactgctcaatagttgcagcaacaacacgacttactccgatgccgtagcaacccataatcatcgtttgtgggcgaccatcttcaccttgtacagttgctttcattgcctccgaatattttgtacctaattggaaaatatgcccaacttcaatacctcgcttaatctgtaaagtacctttgccatcaggacttggatcgccttctacaacattacgtaagtctgcaactttaggtagggcaacatcacgatcccagttaacattaaagtaatgtttgccatcaatgttcgcaccagtgctgaaatcgctcatgagtgccacggagcgatcaataatagccggaattggtaggttcacaggccctaacgatcctataccggcaccaatttttgtttttatttcgtcttcatttgcaaattctagaggatcggcgacttccggtaatttttgtgctttgacttcgtttaactcatgatctccacgtacaatcaatgcgataagaggttggtcttcatttgcaccttttacgatcagtgttttaactgttttttccacagataaattaaattgttcaactaagtcattaatagtttttgcatttggtgtatctactaactccatagttgcactcggtgcctggcgttgacctattgctacggcctccgccaattcaatattggctgcgtagtcggaattgcttgaaaaaacaatatcatcctcgccactttttgccagtacttgaaactcatgagatgcactgcctccaatagatcctgtatcagcttgtacggcacgaaaatctaatcctaaacgagtaaaaatattattgtaagttcgatacatgacatcataggtattttgtaaacattctttgctggtatggaaagaataggcatccttcatcaaaaattcacggccacgcattacgccgaaacgaggtcgcacttcatcacggaattttgtttgaatttgatataagttcaatggtaattgtttataagaactgacttcacgatgcaccaaatcggtaataacttcttcgtgagtaggccccaagacgaaatcacggttgccacgatctacaaaacgtaacagttctggaccatattgctcccagcgttgggactcttgccatagctctgccggttgaacaacaggcatttcaacttcaattgcaccgctcttattcatttcctcacgaacaatattttccacttttttcaaaacacgtaagccggtgggtaaccagttatataagccggatgccaaaggtcgtatcatacctgcccgtaacatcaactgatgacttactacttgagcatcatttggggtttcttttaatgttgataataaatatttactcgtacgcatttttgttcctatatttcatgatcttgaatgaaaaaattggtgatagtgtatcattgagtactattggaaaaaaagtaaaagggataagaaagtcatattttttagtcaagggaatagttatcctttccggtagcgacgtaatttgcgaagtcattatgactaaatccatgagaaagcatataacgccaaattttttgtttagccctagaatctaatttatcacgatagtaaggaaattttttatttaaaacctgtaatactatttcgttccaatcaatttcactttcttgctcaatttcgttaattagttctgctggaatgccttttagctgatacaattcctgtctaattcgctgtaaaccataaccacgttttgcacgataataaaggtaattttcagcaaaacgtttatcattttgccagtttttttgttgacagtgggtaagtgtttgagtaatttcttgctcagtaaaacgtttctcctgcattttgcaacgaagttcaaattcactatattcacgccgagcaagtaaaccaatcacataacttaatgcgagcgaagacatatatttattttcctttgtagttaaatgtagataaagagaatacggacggaagaaagtgcagtcattttaccgcactttctatgatgagagctaaatactcagtactaattaaaaatcactttcaacttcagatatgtttgattctgattcagcttcaagatccgctaatagtgctttttccggatttgctaataattctgaacgtaatttttgctctaaaatagcagcttgctcaggatgttcagctaaccatttcatcgcatttgttttcccttgaccaattttttcgccctcataggagaaccaagcaccggatttatttactaacttatgttttacgccaagttcaataagttcaccatttcttgaaataccctcaccgtataaaatttggaaatcaacttggcggaacggaggtgcgactttatttttaaccacttttacacgagtttcattaccaatgacttcatcaccatttttgatactgccaacacgacgaatatcaagacgaacagaagcgtagaattttaaagcattaccgcctgtggtagtttctggattaccaaaaacaacaccaattttcatgcgaatttggttgataaagacgaccaaacaatttgagtttttgatctgccccgttaatttgcgtaatgcttgtgacataagtcttgcttgtaaaccaacatgagtatcacccatttcaccttcaatttctgctttcggtgttaaagcggcaacagagtcaacaatcacaacgtctaccgcaccggaacgaacgagagcatcacagatttccagtgcttgctctccgttatccggttgagaaattaataactctttaacgtcaacacctaatttagccgcataaattggatcaagtgcgtgttctgcatcaataaatgcacaggttttacctgctttttgtgcttgtgcgataaccgatagtgttaatgtcgttttgcctgaggactcggggccaaaaatttcaacaatacgtcccattggtaagccgccgatacctaaagcaacatccaaactaagtgagccggttgaaattgcttcaatatccagtttttgggtttcccctaatttcataattgcacccttaccaaattgtttctcaatttgtcctagagcggcttcaagtgcttttgctttttcttctggggttgccatgttatacctcaaataaattatctatcagaatttatatataatattatactgtattcacatacagtgcaatttaaaattttatctttttagaaattttgcgatctcatcagcaaaaagagaaaattattctatattattaatcaaattttctaatgcttcttgcattgtgaaccatgaaatttctatatcttcaagtgcttttttaagctgaacctgttcatttaaaagtgcggtgagttttgctttattttctgtctgataaagcactgtatcggaaagaagtaattcaatttcttgtagtttttgttgatatatttgcattttgcgttcaatatcggcaatttcttttcgtaatggtgcactccgttgacgcagttcagcttcttttcttttttgttctttgcgatgattaccggtgttttcgttattattgatgattttctcattatgtttcggcgtgctattaatttcatttagccatttttgatagtcttctaaatcgcctgtaaattcctcaacttgtttatcatgaaccaaataaaattcttctactgtattacgcagtaaatggcgatcgtgggaaaccacgaccagtgaaccttgataatctattaatgcttctgtcaaggcttgacgcatatctaaatccaagtggttcgtcggttcgtccagcagtaataagtttgggcgttgccaaacaataatagctaaaaccaagcgagccttttcaccgccggaaaaagaagaaacagcttgagttactttatcaccatgaaaagcaaaactgcccaagtaatcacgtaattgttgttccgtttgttgtggagcaattttttgcatatgccagagtgcattttcttccgaacgtagcgtatccaattgatgctgtgcaaaataccctaattttacgccttttgctaattggacatgaccggaaagtgcggtcagttcccctgccaataatttaattaacgtagatttacccgccccatttttaccgagcaacccgatacgagatcctggtactaaattgagcttaattttttgtaaaatttccaccgtactttctccattgtcataacctgcactggctttttcaatggaaaccaagggattgggtaaagcgagcggttcacgaaatttaaaggtaaaaggattatctacataagcaggtgcaataagttccattcgttctaaggctttgactcgactttgtgcttgtttggctttagttgctttggctttaaagcgatcgatatatttttgtagatggtttattttttgttgctgttggcgataaagtgcggtttgttgtgctaattttgttgcacgttgcacttcaaaggaagaataattgccactgtattcatgcagtttatgttgttcaatatgaatgattttattcacaataggatcaagaaaatcacggtcatgtgaaattaaaatcaaggtgccttgatattgaattaaccaacgttctaaccaaatgacagcatctaagtctaaatggtttgtcggttcgtctaataagagtaaatcagagcgacaaagcagggcttgtgcaaggttaagacgcatacgccaaccgcccgagaaagatttaaccgttcttgttaaatcctcttgagaaaaccccaatccatgtaaaagagaagccgctctcgcttgaattgtccaagcatcaattgtgtctaattgtgcatgaatacgggcaatatcattgccatgattattttcggtagcagttgctaaggccttttgtaatttgcaatattcacgatcgcctttgataacataatctaacgcacttatttctaaggcgggtgtttcttgatttacccaagccattgcccagtgatttggaaaagttatatcaccttcttcagcactcatttcttttttgagtagtgcaaataaagaagatttaccacaaccattttttccgactaagccaactttttgaccggggttaatagtggcacaggtattttctaagagtaaggtatttccacgctttaaagttaaatttgtaaaaaggatcattagataaactcactattgattaataccgatatctccactcataaatcggaacataattagaggtgaaacctgatgagttgagcaaaggtgaagatcgtacatataacttgcaatgcttagatcgatcaaccgcaatatcgtttttagtctagtcgtgacgatctaaaaacgattgcttatattcgagttagtcgtcacgctaggaaagatgatttggttcgtaaagttcgaagtaaaaaactttacaaaatatccaataattccacttcaaataccaacgtgctgaacggtggaattgatgcaccggcaccacgttcaccataagccaaatgatgtggaatagttaatttccattttgaacctagcggcatcatagataatgcttcaatccaacctgcaattacgccacttactggaaattcggctggttgcccacgtttgactgaactatcaaatacagtgccatcaattaaagtccctgtataatggacacgaacttgatcttgacgagttggaattgccccactgccttctaccaacacttcatattgcaaaccagagtctgttacttttacactgtcttttttcgcattttcttcaaggtattttttaccttcttcttcaatttgcttaaattgtgcttgtgcaatttcgctggcttgttgctgtaattcctgtaacgctttagcaacttcgtttaattctaaagcgggcggattttgattcaatgcgtcataaatcccttttgcaacggcttcagctttaaccgctaatttgctatcgactaattgttgaccgatttgtaaaccgataccataactaccttgagctgaaacatcatctaaggcaacctgtgcaaaaaattgttttgtcattgttttccctttattgtcgttgaaaattatttcttataagccaatacttcgcctacacgtacaggcacaccaacgtctaaatggtttgccagttctaccttatccgcttggaatagattgatcactgttgaacctaactggaatgcccccatttcttgtcctttacgtaattgcaccgcactttcgtcgctataagtccactctttcacttcagtgctgcgtggtggattaattattcccgcccaaacagtactcatactggcggtaatagtcgcaccgactaaaatctgtaccatcgtgccaaattccgtatcaaaaacacagatcacacgctcattacgagctaataaattaggaatatgttcatttaaaaacggattgaccgaaaataaatcgccaggcacatagatcatcttacgtaaagtagcatcgcaaggcatatgcactcgatgataatctcgaggagaaagataaattgtggcaaattcaccatgttcaaattctttagccaattcagtatcgccagccagcagatctactaagctaaaactatgtccttttgcctgcaacaaagtttgttgctcaatatgtccacattgactaattcgcccgtccgcaggtaaacaaagtgcggtaggattttcatcaatttttctcgcatcagcttttaacggacgaataaaaaattcattaaaacttgcatagtccttaaattctgttttttccgcttcttgcatatttacacgatactttttggcaaaaagtttaataataaaatgcgttacacttccccatttttgttttgccagccagccagctgccaaagttaaataaagttgtggcatgacatattgaaaagcaattttcaaacgttgccaataagtcggttgttttttttcagcattatacataacaggtttccttgtaaaaattggacgaggattataacaagttattggtgtaatgtaaccagcagaagagttattgtttgtcgtagaggggcggttttaatctaaagttaataaatagacgttaattatgaattggttaagtcaagcctattattggtgtataatggattttaataaacagagagggagatataatatgtgtacgattatgcagaaagaagcgaatttttggcagtgatcgagcgtttaattaaatggaaactcaaagattaataacatagataagagaatcaattatgcatatcctgttgcaaaaatattataattatttacgcattgaacgacaactcagtccatatactctcataaattatcagcgtcagctggaaaaaattgtagtgattttacaacaaaacgatattcactcatggcaacaagttacaccaagtgttgttcgttttgtattagcacaaagtcgcaaagaaggattacatgaaagaagtttagcgttgcgtttatctgctttacgacaatttctaaattatttggttgtacaaggtgaattaaaagttaattcagccgttggtatttctgcacctaagcaaagtaaatatttaccgaaaaatatggatatggaacaggtgcaacaattattgactaatgaaagcaaagaacccatcgatcttcgtgataaagcgatgatggagttgatgtatagctcgggtttgcgtttatcagaattacaaagtttgaatttgaatagtattaatattcgctctcgtgaagtgcgtgtcatcgggaaaggaaataaagagcggattttaccctttggacgttatgcttctcaagctatccaacaatggctgaaagtgcggttgttatttaatccgaaagatgaggcgttgtttgtcagtcaattaggcaatcgtatttctcatcgttccattcaaaaacgtatggaaacttggggtattcgacaaagcttaaacggtcatctcaacccacataaattacgccattcttttgctacccatatgctggaaaacagctcggatctacgtgcggtacaagaattattaggacatagtaatttatccacaacccagatttatacccacttggattttcaacacttggcacaagtttacgacaaagcacaccctcgagccaaacgtaaaaaatagttggaagcaggcaaattcaaacgaaatattaccgcacttgatggacgttcaagcacaatttgacaggttaccttgctcaacaacaatgccaacattattagcttgtgctatcgctttaggtttacttaattttatttttacccaagaaatattaaattttactcttaattgctctgcaacttcgtaagctactcgctcaattaacaaaaatgggcgagattgaacataattcaatataaactcactcacttccgcataatttaagcaatattttacatcatctgtttgtgcagctcggcgacaatcccacgccatttcaatatcaaaaatgagcttttgcttgatttgctgttcccaatcataaacaccaatttgagcaagtgcggtcaatccttcaataaatattttgtctgtcattataactccgatgaacaaaattccattaggcttatactatcaagtttatgtacaatagacgaacgaaaattttctgttcctgcgatagggagttgatgatgagtttgtttgcgattatttatatgttattcacttatttgttagggtcaatttcgagtgatgttgtgatttgtcggtttaccgagcgaaacgatgctcgtgtaacaaactcaaatgtattacaaaaaggggggtatcggcttgttttggcagtttttctatgtgatgtcttaaagggtatgttgccggtttgggtaggctattatttagggttaacttactttgaattaggcatgatagcactcaccgcttgtttaggtcatatttttcctattttctttaaatttagtgggggaaaaggggtggcgaccgcatttggtgctatcgcccccatcgcttggggtgtcgccggctcaatgcttggtacttggcttttaatctttctctttagtggctatgttgcattaagtacggtcgtaactgcattaatattgcctttctatgtatggtggtttaaaccagaatttacttttcccgttgcattagtttgttgtttgttagtttatcgtcatcatgaaaatatccaacgtttatggcgaggacaagaagataaaatttggtctaaatttaaaaagtaacgttacatttgcttgcttaaaaatttaaatagaaatcttgggttaaggttttaaattctgtactgtattgattgttccgatcataaataaccaactgactttcctcacatttccgttcttctcggctaaaactaagtaataaacgctgtggagttttacctgctttagtgatgattttacattctctaatacaaaaaagaccgcactttttttgtaaactttttccttcttcaaatggcaaaatcaagtgaatttcacccgttaggtttaatagtttttcggcggcgtttagccaatccaagtggctttgtgttagggtatagcgagctagattgcgttgtttactggcacaatcaataccttgcttaaaataaggtggattcgccgtaatgacatcaaatttatgctcacaatcttgtgcaaaaacaataatatcttgttgaaaaatcttgattttatttgcccaaggactttgttggatattgtcttttgcttgcaaataagcctgcggatccaattcaactgcactaatgtgacaatgttcggaactacgttgagccaacattaacgcaattaatcctgtaccggtacctaaatcaagcaacgtatttgcttggtcgatatttgcccatgcacccaataaaatcccatcagtccccactttcattgcacatcgatcttgcttaatgtgaaattgtttaaacgtaaatccttgctttttygyyataaatatcctgaaatttgaccgcactttaaagacaaagtgcggtataatttgccacaaattttttttgaataccaattctttaatacggataaatatgacatcaacgcaatttgaagacttcgatcttgctcctcaattactaaaagcccttgtccacaaaggctattctcggccgacttycattcaacttgaggccattcctgcgattatggaggcgaaagatgttttaggttccgcaccaacagggacaggaaaaacagcggcatttttgttacctgctattcagcatttattagattatccacgtcgtaaacccggacctcctcgaattttggttcttacaccaacacgtgagctggctttgcaagttgcgaaacaagcggaggaattggcacaatttacgcatttaagtattactactattaccggcggagtggcttatcaaaatcatggtgaagtgtttaataaaaaccaagatattgttgttgctacaccgggacgcttactgcaatatattaaagaagaaaactttgattgtagagccgttgaaatactcatttttgacgaggcggatcgtatgttgcaaatgggcttggggcaatatgcagaagaaattgcggcagaaactcgttggcgtcggcaaacattgttgttttccgctacgcttgaaggtgagttattaatggattttgcctctcgtttactgaaagatccggtgcaatttaattcagagccaagtcgtcgtgaacgtaaaaaaattaatcaatggtattatcatgcagatagcaatgaacataaaattaaactccttgcacgttttattgaaaatgaacaagtaagtcgtggtattgtatttgttcgtcgtcgtgaaaacgtgcgtgaattgtctgaaattttacgcaaacgtggtattcgtagcacttacttagaaggtgaaatggcacaaactcagcgtactaaggctattgataaactgaaaaatgatgtggttactgtgttagttgctaccgatgttgcagctcgtggcattgatattgatgatgtcagtcatgtcatgaattttgatttgccttataacgccgatacttatttgcatcgtgtcggacgtaccgcaagagcaggcaaaaaaggtaccgcagtatcttttgttgaagcacatgactataaattattaggcaaaataaaacgttataccggagagttgctaaaacctcgtatcatagagggcttagaaccgagaaccaatccacccaaagatggtgagataaaaacggtgagtaaaaagcaaaagaaccgagctaaaactaagttggaagaaaataaaaaagcggcacggaagaaaaaacaaaaacttcgccataaagacataaaaaacattggtaaacgtcgcaagccaagcgaaaaaatcgctgaataaagcggtaatatatcccctgcctttaaggggattatgttattgatactttaaaggtataatcttcaattcactttcatcaacaggcaatctaaaccgttggttttcttctaattggttactcataatgacttgcaaatataaaataccgttaagattgaccgcacttaaaatacatcctattttacgccaagcatgttctaattgcatttcaatttcagtaccaatttctacaagtgcgacagttttggcttgcaataaatacatggcacgtttatttatccctcgatatttggctcgagctatagtttcttgtccaatataacaacctttttggaaagaaatagcttgttcgatttcttgtaaattcagtgcttgtggaataaattctccttgtccgattattgttaaaattggaaagccttgctgcatatccaagtaatcccaatattgtgtatcttgcgtatattcaaggctcattttctgttcccaacataaaatctggcgattacccaaatcaatacgaatttgtggtgaaatagcaccgcactctttcagatcctgagcaagcatgcccacaatagtccaatttttttcactaaaagtcacttgagaaaaaaccgcatatttttttaattgagctaagccatgattgagtaaatcttggcggattaagagataaaattgttgttctgcatgacgaattagacggaaaagagaattgactttacctttcggatcgcaatgtgcggttaatgtggattgaccgattgccaactttgttacatcacaggttaattgtccttgtaaaaatttttcggcatcaacgccttctacataaattaaaccatattgcttaagattaattaacatttttgtccttattcaagattttggatttgttcacgcatttgttcaattaagacctttaattcaaccgctgatgaggtaatatcggcgttaatagatttagacgcaagtgtattactttcacgattaagttcttgcatcataaaatcaagtttacgcccgacagccccgcctttgtgcaaaatagcgtatgtttcttttacatgtaattgcaaccgatccagctcttcagctatatcaatacgttgtgccaatagcaccatttcttgttcaatacgttgtgtatctgcttgtaattgaatttcatcaaaacgttgttgcaaacgatctcgttgccattgcaatatttccggcataaaagaccgcactttttgtgcctcaacggaaattgccataaggcgttgttcaattaatttttgaactttttctccctcacgagctcgtgttgcaataaactccacaagcaaatcatcaaaggcttgcaacaaatcttcgatgatactgtccaagtcctgttccggcgtttccactacaccggggtagcgtaaaatatccatcagattgatttcaccctctccggcttgtgcttttatatattgcaaagattgaataacctgtttggcgaacttttgattaagatttaagttgagtgcggtttgttttttagtgtcaatacgcaagctacattcgattttacctcgagccagtttttgccgtaatttttcacgcaaagtattttccaatcctcgaaattgctccggtaaacgaaaaaaggtttctaaataacgttgattgaccgagcgaatttcccatacggcatcaccccattcttttttaatttcaacacgagcaaaggcagtcatactgtaaatcatatttttatatcctcacttttatattaatttaccggtgttattgtactgttaaatttcttttatgtcagtttgcatgataaaattgcaaaaattttttaacttcattcaaaggaatatgtcatgcgtccaaatgcgagagcaatcaatcaaccccgtccaataaaaattactcgtcattacactaaacatgctgaaggttcggtattagttgaattcggtgaaactaaagtgatttgtacagcgacggttgaagatagtgtaccacgttttttaaaagggcaaggaaaaggttgggttactgcagaatatggtatgcttccacgctcaacccatagccgtatgcaacgtgaagcggctaagggtaaacaaggcggtagaacgatggaaattcaacgtttaattgcacgctcattacgtgctatggtagatttggaagctttaggtgagcgtgcaatcacattggactgcgatgttattcaagcggatggcggtacgagaacagcatcaatcacgggggcttgtgtagctttaattgatgcaattaattttttgctgcaaaacggtacgttgacaactaatccgataaagggattagttgccgccatttccgttggtattgtcaacggtgaaacggtgtgtgatttagaatatgtggaagatagcattgccgaaacagatatgaatgtggtgatgatggaagatggacgtatgattgaagtacaaggaacagcagaaggcgaaccgtttagccatgcagaacttcttaccctattagatttagccaaacaaggttgtgaacaactttttgtggcacaacgtgttgcattagcggaataaagatagtttgtgtaagataaaaaatctacaatatacatttttacaatgtaagaatatcgcaatgaaaatggtgtggaaatacaggggttaaaatgaattttcttggaaaaataatcggttttatttttgggtggcgttttggtggtttttttggtgctgttgtcggcctaattctaggacaccttgccgataagaaactgtatgaattaggaagtgtaaattccagcttttttaaaaataaactcactcgtcaatcgctctttatgcaaactacttttgccgtattaggacatttgaccaaagcaaagggtagggtgaccgaagatgatattgcccttgcaacaagcctaatgcagcaattaaatctggatgatgcaggcagacgtttagcacaagaagcatttaatcgtggtaagcaaactgattttcctctccgtcaagttattcgagagtttcgtttaggttgtggacaacgagcggatttgttgcgtatctttttgagtattcaagtcaaagctgcttttatggataatgaattgcaaggtgcggaaaaaagtgtcttacaaattgtagcagaagagctagggttatctcgtttccaatttgagcaaatacttgcgatggaattagccgctagacactttagtcgtggcggtttttatcaacaaagtcgtacttaccaacagggaagttatcatcaatatcaagagcaaggacaatatcaaaacagctatcatcaatcaggcccaacgttagatgatgcttacaaagtgcttggtgtatcaggaaatgataatcaacaaactgtaaaacgtgcttatcgtcgtttaatgaatgaaaatcatcctgataagttggtttctaaaggattacctcctgaaatgttggaaatggcaaaagaaaaagcccaacaaattcaagcggcgtatgatttaatttgtaaatcgaagggttggaaataacttaatgcgagtttttttagcacctatgcaaggtgtgcttgatccttttgtacgtcaactattaacagaggttaatcaatatgatctctgtatttctgaatttgttagagtagttgatcagcgtcttcccaacaaagttttttatcgtttatgccctgaacttcaccatcagggctttactttgtcaggtacgcctgttcgtgtacaacttttggggcaatatccgcaatggcttgctgaaaatgcccaaagagccgttgaattaggttctcagggcatagatttgaattgtggttgtccgtcgaaagctgtcaatggaagtaatggaggtgcttcattgttgaaacaaccggaactcatttaccaagcaacaaaagctattcgtcaagctgttccaatggaacagcctgttagcgtaaaagtgcggttgggttgggataatgttgatcaggtttttgaaattgctgatgcggtacagcaaggtggagcaacggaaataacgattcatggacgaactaaaagcgatggttatcgtgctgatcggattaattggtataaaattgctgaagtcagaaaaaaattacgaattccagttattgccaatggtgaaatttggcattggcaagatgggcaaaattgtttagccattactggttgccaagatttaatgatcggacgaggggctttaaatattcctaatttaagttatgtaataaaattcaatgcggaaaaattagattggcaacaaggtgttatgccgatgttgcataaatatgctcatgttgaaaatgaatttgacaaaggtttctatcatattgcaagaattaaacaatggctacaatacttgaaaaaagagtatcctcaagctggcacactttttgagcgaattaaaagctgtcaaagtgcggcggaattacggcataaaatacaataaaaatggcgtgtaatttacgttacacgccatttttcaaccaatgtatttattttacacgagaaacatattcacctgaacgggtatcaactttaatcacttcgccaatttgtacaaatagaggtactttcactaccgcacctgtacttaatgttgccggtttgcctccagttcccgctgtatcaccttttaagccaggatcggtttcaacaacttccaactcaacgaaattaggcggtgtaatcgttataggtgcaccattccataaggttacaatacaatctgcttgatccagcaaccatttttccgcatcacctaccgctttggcatcagcagagtattgttcaaaggtttcaggatgcataaaataccaaaacgcttcatctttataggagtaagtcaggtttaagtccattacatctgccgcttcaactgatgtaccagatttaaagttgacatccaatactttgcctgaaattaatttacggatacgggtgcgagtgaacgcttgccctttacctggtttaacaaattcattttcaataataacgcaaggctcaccgtcctgcataaattttagacctggtttaaaatcactggtagtatatgtagccatatcatcctcaaattaaaagagattgtttttaacaaatgcgtattctaacccaaaatagcataaatagagaagaagaaaattggactgattacctcgcaaaggcaatttccgatcctatagaattacttaattatttagagttaccgattgaatcgtttcagtatgacattgcggcacgtcaattatttccattgcgtgttcctttcccatttgttaaaaaaatggaaaaaggtaacccaaatgatccgctctttttacaagtgatggcttcacagcatgaatttttgccgatggcaggatttaccaaagatcctttggaagaacaacataacagtgttcccaatattttgcataaataccataaccggttgttattaatagtaaaaaacagttgtgccgtcaactgtcgttattgtttccgccgtcatttcccttatgcggaaaataaaggaaataaacaaagttgggtaaaatcgctggattatattgccgcacatgctgaaattgaagaagttattttttcggggggagatcctttgatggctaaagatcatgagttagcatggttaataaaagagcttgaaaatataccgcacttacataccttgcgtattcatactcgcttgccggttgttattccacaacgcattactgatgaactttgtcggatattgagtgaaagtcgttttcaaaaagtcattgttactcatattaatcaccccaatgaaattgatgaaatattagcctgtgcaatgaaaaaattaaaacatgcgaatgtaaccttacttaatcaatctgtggtgttaaaaaatatcaacgataatgcacacattttaaaaaaattaagtgataaattattcagtatcggcattcttccgtattatttacatttattagataaagttgagggagcaagtcatttttatcttgatgatgaaagtgcggccgctatttataaagaattacaacgcattagttcgggttatctcgtaccgaaacttgctcgtgaaattgctcatgagccgaataaaacgttgtattcggcataggaaaaagaatgaagatcctttaaaatacataaaattttaccgcactttatgtgcttctttaaacataactttctgactcatcaagggactatcatgacagctgaacaaaataaaatcgacacttctggacaagcttctatacaaaaagaattggagcttgatctggatcctatggagccgatacttccgaaaaaaaatcttgcatctaaacaaactttattggaaaaagccaaacgtattttcaagagagcggataagcaaaatagagttgataaagcagaagtgagtacacataaagaagtaatatccgctagtgatgatgaacaacgtccaataatcacggaaacacaagagcaacaaataagccaagcaatagacccgactatatctgaagtgcctgttaagacacaaaaagaactgaaaaaaccggaaaattggactatgttaggtgtgttaccgcctaaatatcgccgtatttttattgcattattagttgtcgtcattattttattaattatttcttggttaaaaccggatgataatatagagcaatattttgaacaatcaacaggcaatagtattccgacacaatttcagcctttagatcattctcaaccggttgaaccgagcattttagagcaactgaagaatcctcaaccaaaaagtgaaaatatcacacagaatgatcaggaaaaaaatatgcctgtacaagcgttgcaggtagaaaacgaaccccaaaatatagctataccgataaattcaccacctagtaaggcggacagtccagtagtggaaacaagcaagcgaccaagtattaaagttgaggaagcaacatctcaacctatagcaccaatggaagaagtgaaaattgttgagaaaaatgagccaaataaaaaggcagaaaaacaggtgaaagcagagcagaaaggcgtgcctgttgttgatgcgaaaccggctaatgtgaataaagtaacaaattcacagaaaaccgctctacaaaaaaatgcacagactaaaacccttgttattccgcaaggaacctcactgatgcaagtattccgcaacaataatttgaatattgccgatgttaatgcaatgacgaaagcaaagggagccggtaatacgctaagtagttttaaagcgggcgataaagtacaagtatctttaaataaccaagggcgtgttaatgaattgcgtctatccaatggtgctcgttttatccgccaaactgatggaagttatcaatttaaaaaataatgacattaagcaaaacggcgtaattttcgcttacgccgtttgattgtcgaactaaaattttttctatttacaaccgctctttttctccaccgaattcacttagcaagttttccgttaatttggcaagaatgccggtcattaaaacaaagtctgcatcaaatcgttgtgcaaaatcttcttttgaaatatcgtcattttgttcacgaatttgatcggcaaattttaagcgttttaaactggcatcttcgttgagagtaaaacttaaatgttcttcccagttgagggataagtttgtgatatatttgccggaatttaacaatccgatcatttcttcactgtccaacacttgttgtttgcaacgaataacggcttgatcttggcttccttttaattccgcctcttccaatacagtcaaccattgaggtgagttttccttaacccaatttgtcatcaccaaacttggctcattagcaaatacaagtggcacaactggtaaagatcctaacgattttcttaataaagccaaacagtcttccgctcgtttagttgaggcggtatcaatgtaaataaggttattttccgtatcaatccacaacgcagtatgttggtttttactgaatgcacgaggcaataacgtagcgacaatatcatcttttaacgcttgtttttcgatttttttcagtttgcgattttctttttgctcaagttgttcaatccgttcttccagctcacgtttaatcacttgtgcaggcaaaatcttttcttctttgtgagcaactagcaagagttgttttccaacacaaaaagagagagattcactttcacgcaaaggattgctccaaccgaaccggctcatgtctgattgttggcagggagaatatgcacattgttgtaactgtgattgtaaattttctaccgaccaatcaagagatttagttaaacggtaaattaaggcatttttaaaccaaaacattgttcttcctcaaggtttttcatgtaaaataagcactattgtaacttattcgagatgaaaatatgcaacataaattgattagctttattggtggaggaaatatggcacaagccattgttttgggattattaaaacaaggctatcctgcacattacattcgtgtttgtgatccgaaccaatctcgccgtgatttatttattgcgcaaggtacgcaagtaagtagcaacaatgtcgaggcaatacaggatgcggatgtagttttacttgccgtgaaaccacaaattatggcggaagtttgtgtaccgttaagtgcggttgatttttcagataagttagtgatttccattgcggcggggatttctaccgtaagattgaccgcacttttacccagtgcgaaaaatattattcgtgttatgccaaatacgcctgcacttgtttcagcaggtatggcaggtttatttgcgacaccgcaggtttcggtaaacttaaaacagtttgcacaagatttattaagtgcgatgggggaaatttgttggcttgaacaagaacaagatatgcacgccgttactgccggttcaggaagtagtcccgcttatttctttttatttatggaagccatgcaacaggcattaattgaaatgaatttagatccgaaaactgctcgcttattagtgcaacaatcagcattaggtgcagcgaaaatggtgatcgaaaatccacaaatcgctttatcggagctaagggaaaatgttacttcaaaagggggaacaacagcttccgccttagcggtatttaatgaacaaaatgtgacgcaaataatcaaacaggcaatgctggcttgtgttaaacgttcacaagaaatggagagtttattttaaatgagagtttcaccattcagctggattgcaatttgtttgtttggctatttttttgcttacggcgtgtttgttccctattttcccgtgtggttaaaatcacagtcctataatgaaaccacaattgggttaattttagccggagcttacttttttcgtgcattgggcggaatttgggtttcctctttggttaaacgtccctcacaacttattagcggcttgcgttatttagcttgggcaacttgtgtcttgatgtttgtcgccggttttatggcaccgcacttttggctactttgtatcttaatcggactgttttcgatggcaagttccggaggattgccattaatggacacgctttctaccacttggcaacagcaacaaggtttagattacggtaaagcacgtatgatcggttctattgcctttgctgccggtgtggtgattttcggctatgtgatagaaatgattaatgcgacaaatattgtatggatgttgaccgcacttttattcgtttatgcaatagggcaaatggcaaatccaacttatccgccactcgatcatattgaatctacacaacaagaaaataatgaaacggaaaaaacggattttagctttatacaattattaaaaaacaaagttacactacgtttgcttattgcgatttcgcttattcatggttctcatgctgcctattattcttacagcgttttatattggcaagaagaacttcatattccgcttcaagttattgggggtctttgggcattaagtatcgtggcggaaattgtcctcttcttcttttcatcaaaatggtttcgacattggaaagtcagcacattattttatctttctgcgttaggtgcagtggtgcgttggggcggtttaagttttgccgataatttgggtattgttatctttatccaacttttacatagtatcacttttgcgaccagtcattatgccattatccgctatatttccacacaacctcatcaagcgatggctaaattacagggcttatataacagtttttccgcctgtattgcagtcggtttattagcgggactttccagtcttatttatccaatctcaccgttttatacattcttaactatgatgttgattgcggcactggcgatccctattattccgagaaatatcaatgcctttcgtcaaagtatcatcactcgagtgaaatcatgaaagacaacgcattaattgatctttttttaaatgaactttggttagaaaaaggattatccgagaataccgtgcaatcttatcgcttggatctgaccgcactttcgcaatggctggagcctcaggggttgagtttagaaacccttgatgtggtagatttacaaacattcttaggcgagcgtttgacacaaggttataaagcaacaagtactgctagaatgttaagtgcattacgcaaactttttcaatatttgtatcgagaaaaataccgttcggatgatccaagtgcggtgttaagttcacctaaattaccgagccgtttgcctaaatatctgacggaacaacaagtaacggacttactcaacacacccaatacagaaattccgttggaattaagagataaggcaatgttggaaatgttgtatgcaaccggattacgtgtaacggaattggtgagtttaagtcttgatagtaccaatatcaatcagggtgttgtgcgagttatcgggaaagggaagaaagaacgtattgtgccgatgggagaggaagcaaactattggcttcgtcaatttatcctatatggcagatcctttctcttggcagggcagagttccgatgttgtttttccaagccgtcggggaactcaaatgacacgccaaacgttttggcatcgggtaaaatattatgcaatattggctgaaattgatacttctgcactttctccccacgtcttacgtcatgcttttgctacgcatttagttaatcatggtgccgatttgcgtgtggtacaaatgttactgggacatagcgatttgtccactacacaaatttatacacatgtggctaaagagcggttaaaaattttacacgaaagatttcatccaagaggataaatttttttatatttttttgtacacctgtatcgtataatgctccgttagtttaaaaagacaaagttaaactatttaaaaaattcatttctttgatacataaggagtttttatgaaatacaaactatctttagcaattctgtcaatactgcccgcactttcccatgcgggggggggtaatttcaacttttacggcaaagcaggaatcgatttaacctctcgttttgaaacaatggttcttagaacagaacaaaataattacgtcccgagtattcctgcaagttcaagacaaaataccttctcgccaagtatcttttttgaaaccacctacactattttaccgcaaacagaaatcggtttgggactgggctatatcaaacgcaaaggcttcgatcattctgccagctggcattttaataaggatgctcaaaaaaaaacgtggacacaaacatcaggtctcacagacatcgaacaatatagaatttaccgttattcttccctaccaatttatctcatcttgaaacagaattatgcgtttaatgcaaacagcaaattttatctaaaagggaatataggttattcaatcaataaaatgcctaatacaaagtatgctcattattcaaatgagacaagccgagaaattcagcaaacacaaattggcgatcctatttataaaatgaaagcaaaaaacgggctgtatttagggttgggtatcgggattgaatataaatctttcttagcggaaattggttattaccatacccatgcaactgtcagttacaaaaacaaaaatacccaatatccacaatattcctacaacaacgatgccatacgtttaacccttggggtgaaattctagaaaatgaaaagcgactaactgcggttagttagtcgcttttatagaaaatttttatatttttttgtacacctgtatcgtataatgctccgttagtttaaaaagacaaagttaaactattttaaaaaatttatttctttgatacataaggagtttttatgaaatacaaactatctttagtgcttttgtcaatactgcccgcactttcccatgcgggggggggtaatttcaacttttacggcaaagcgggaatcgatttaacctctcgttttgaaaccatgcaactcagaacatatctgaacaatgacgtaccgagcattccagccagctcaagacaaaacaccttttcaccaagtatcttttttgaaaccacttacactattttaccgcaaacggaaatcggtctaggattaggctatatcaaacgaaaaggcttcgatcattctgccagttggcatgtacatactgatggagaatgggtgctaagtggggacaatactgctgttgagtactataaaataaatcgctattcttccctgccgatttattttacgctaaaacaaaattatgcctttaatgcaaacagcaaattttatctaaaaggggatataggttattcaattaataaaattactgacaccaaacataagaaatacacaaatattacaaataaatttgagttactaagtgaaaatctacgtaaaatgaaaacaagaaacgggctttatttaggtttagccattggacttgaatataaatcgttcttagcagaaatcgggtattatcatacccacgctgcggttaattataaaactaaaccttacaaaagcaaagcagaaggctactatgcttggcattcttacaacaacgatgctatacgtttaacccttgggtttaaattctaaaaaataaaaaagtgattaattgatctgcacctaaaagttggactaaacaaccaacgatcagtgtgcagatttttatgacaaaagataacccatctttcaaatagcaaatcatcgttgagttttatttatcaaaaaagcagtgatcgctcactgcttttttatggtcgttcaactaggttaccaagcccagccgatacccacaccgccaccgaagtcgccgacagagttgctatttccgtgtaatttcaacagaaccttaccgttatcactcacacgagaatagcctaaagcgaccgcactttgacctttatacgtaccggcagagactgaaagcactgatttccccggaatcgaaatcgtaggcaatgccgctgccgcattcgaaccggcaattcctgctcgagattctttactaaatgcatcaaatctattttcaagctggttgaattttttgtcagtatgtgtttgtaaggcatcgacatatcctttgttaaccacggcattcggtgaagagttcggcrttaaatccggcactctgatttctcctttcgccccgtcaatctcaatrcgytgwccttgcggrttggtcaaggttaatccgctygrsgtsarmgtygyacygtgcttaccgwcmgtyaatytyackccrtckrmmycrtawtgtgccgatttgccgtctttatgrrttacccgtaatccgttgccgtcaagacgggatttattcccctctgcggtttctttggtttcaaaagasgtcatrtttttcaacktrtcggacagtttgacwtccagtcccgtctcggaggcgtccactttaatattgccckccgccgtggtcrcactgttaaactcrccctcgcctttgatggtcaatttctcgcctaaatttttatggacaggcacgccgtcattgccctcaaaatttaagcccgcttgtcctaaagccttcacgtcttgaagattggcagcacgcttcacatcaatgctggaatcatctgacaaaaacttattgactgcgtcatcttttgtggctaatgcggtttgataggcgtcttgcttcgcttttaatatgccttgtgccgattcaacctcttttttcgccttatccaatttcgagttaatgtcggctaatgttgatttttcgccctcgatcttagctttggctttctctttcgccgctttttcctccggtgtagtttccggcatgaaagacaatgcggtttcaagagcgtcaatggcgtcctgtttcgcctcttttgctgtttgtagcgtcaacatatcgtctacttttttcgccaccgcctgtgcttcggttttcactgcttcgcctgcctttttcacgttttcggcatgctctttcgctttgtcggcatcaatacccaaaccgcttgccacgttgcnnnnnnnnnnnnnnnnnnnngtcggctcggctttgatcacgacttgttttgcttcatcgccagaaagttcttgatcaggttttccgtctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggatctgccacaaatactatttttcttctttttattgcacttcctactgataatgctccctctactccttgtgaactattccctaatactattgcatctcttatggtttcatctgctttgatatgagatcctaataatatattttnnnnnnnnnnnnnnnnnnnnnnnnnnnnnnnnnnnnnnnnnnnnnnnnnnnnnnnnnnnnnnnnnnnnnnnnnnnnnaatacaaaagaataatgaccttctactttattttctttacctacagatattgaactaagacctaatacatcagaatcttgtcctattgatattgcaccttgattttttgcgaatgaattataacccaatgctatcgaaccctcattttgcgataccgcattatgtcctatagaaattgaccctgttcctattgcttgtgtttttgcagaatcagaaagtttaacggatttatcccctgtgcctttcagatagtcgactaaggctttggcttgtactaattcgcttgtaccctctgtttcatcttctttaagattgattttatcaatgccgatattagaaccaaaaatcgctttatctttaacatttgcaccatctatttctaaataatactcttctaaatcccctactagagtatctctttgagtatattttttaagctcttccgccacagctttagatgttacaactttgtcactatctgggttaaaagtcgtttctttatttaacgttaacgtaagtgctttttctgtagcacttgctgtagccattatatctacaccagttccatcacctttgattgtgatagtctctccaagtgcaacgttggctgtaccgctatttcctgaaaatgttaatcctttaccaataatcgctttagccacatcagataagtcttttacgtttatggcattattttgaacagtatctatagacgttccagttaatacattttcaatattagttgctacattatttgcagtcgaatctcctaaaccacttgcaacacctgaaattttaactttatcactgtctgattttgtgaatgttaatgtcgctccactttcagggcttaactcaatttgctttttaccattacttgtaattttaagacttccagcatcagttcctgcagtgatggtcgcctcattctcttttaattcaagttttgatttatcatgagctaattctacagttgctttatcagcattaagtgtcaatttggatttactgtctttactactaatttcagaaacgccactgaatttatcttctgttaatgttacagttttacctgaatttccggctgtgaaaacgatagattttccacttccattagttccattgtttaatgaaattttcacatcgtcaccattagcaactgattttatgccggttaaagcatcttttaatgtgatacttactgtttgcttattcttatcaactttagtgtcaatatttttgctatctcctgcaattgttaattcattatgctctttatctaatgtatatacttctttattatccttactattatcacccttaaccgtaaaattagctgcgactttttctaatcttttgtctaaatattttttgttgacagcatagttatcataagtatttttcttaggattagctggctcgtcttcgggaatatcattttcaattaatacatttttaaaagtaggtgattcttttattcctattaataattgcttactatcttttagatatgctgttttaatattatcaggaacgtatcctccttcttgagtagtagttggtttatctayagctcccgctttaatgattaatttatcacctaaataatgcgttcctttttcagtatcgccatctccgcttccaaaaataaagcccttattaattttatctatatttgcctctattgccgctttaaatgttttttcttcttttagtatctgtccattttgttcagttccatttttaaatttattaaattgtgattttttaaatgtaaatttaccgttatcaacttccgcacctaatacatttgttgcaaagttctttaattgtaaaaagttaacagcatgattgtcattcgttggtgcttcagtaattgttacactcttaaattcaggatcgtcttttaagccgatagtgaatttagcaacggaattgtttgttttgccttgttcaaatttcgtttctaaatttttaccgacatattttgttttactgtttgattcaatatctccatttacaatttcaatcgtagatcctaaataaaacggtgtatctttatttggatggtcaggagtaccatcactaaacttatacccagagttaatcgctgcaatggtttccgttaaagcagccttaaaggtatcttgtgatcccttgtctccagcttcaacataattcacagcagtaaaatcatgttttttaaattttgtttgactatctttttgatattctaatcccaatgcctcttttgcactatttaactgtgctcccgtaatcgcctgatcggaagtcgctgaaatttcgccatcagccaaatgtccaaattttattgtttcccctatgtcagcagttgtttttccatcagcaaatgtttgagttttttcatcaaatcctttagcaccaacgaagactttgttcttgtcaattttgcctaatttttttaaaggttcgccatttcttgtatctactctataaaattcaccgtcatctgatgctttcattaatttaactattttgttattgttatccactgtataataaacaaccaacccctctttttttacatattctaatgtttttagctgaccaacagtcgccacatcagaatccaacgctcccggtgcaacatttattattcttctaagtcccactgcctctgtgtttgtaccttcgctaaccttccaaccaccaacagatatcaccccataagaggcatcattttttatttcgtaagttgaacccgcagctttataagcatctaatttagaagctggttctcccgataatttaggcgtaaatttgtcgcttgcatctgctttgttatcataaaaataattagttgttgatttatatcctaatgcaacagaattagacaaattggcttcagcttcattacctaatgccaacgcacctgtagcatctttacctacacctgcttctataccaagtgcgatacctttttccgcttgagattgtgctttataaccgatagcaactgaatattgtttacctgaatacgtattattccctaacgcaattgaggcttsrccaatggcacgtgtraaactycckatygcaaakgcrtytttttcttttgcaaatgaaaatcttccgattgcaatcgcactatcyycyttggcrtaagcrtatcktccwattgttagygtattgtctccyaatgcgacygaatacgaacctatcgctattccaccttgattatatccgagtgaayctcttgattgtttcgcttttaattcttcygttccmtcttgtttggtmgttttaggtttgattaatctagaataagtttgtatatctgctgtatttcctttttcatataattcttcaaaatcaaattttgcaccatatgaatttttactatccgttaaagtaaagccattattattttgaagtccaycwttattraamttmtyatccatctctatatttgcyaatgcataatttccaattgccartgaacctctacckccygcatacgaatcggaaccgtataccatagcaccrtcattaattgcttgtacrttagtacctaccccaacygttctatctgcatayacatacgatttgtttccaagaactaatgattctttaccaaatgcgattgtatctgaaccaattgctgttgaataatctttaaaggcaatggcaaacgttccgattgcagtcgtrtaatcaccrtatgcaatacttcttgccccaacygctattgmatttttccccckagcccawgtgtgagttyttytattatcgtatttaactccatttaattttttttctttctctattttgtttccaccgtccttatctaaatatttttcataggcgacatttactttagaatcatattcttgttttcgtagataatcgtctttcttttttattttttcaatttcacctctttctgtaactttatcatatgaatgaccattgtttttataaaaaacctcttcaccattatcatttttgataagataataactactccatgttttaccatcgtctcttacaaaatactctccatttaatactagagtattaccatcttttcctactaactccccwttrccattaacataytcattttttyyrwcacyatwaatwycyaayaaaaatctaaaatcaactgccggatattcmtctgtatagttaaarttttgtgcattatytagaaacaatctaaagatgtcttttggtagttttttttgttttgyatctgcayttccgataccgtctgatccaatcgcaattgaagaatctccccaagcaactgtatcattccctaatgatgtcgccccygctcctctcgcaaargttctatatccaaccgcwgttccttgtgcrttagcattatcaatatttttayctttagtgttttctccaacaatcgctttatatcctattgaggttgcaccaattccaccacccacagcacgagaacctataatgactgcatatttggcktsttsattttyaatryyagattcagcacctgctttatttgatttgtctgctaataatattagttcttgatgttkwtctttaatrtttttattygctccrtcataccaaatacttgtattgtagttagatttaccgtgttctctggatgtattattatctatccacacatctgctccatacgctacactcgacacccccgacatcgccaacgccagcggcaggaccttaaacgcccctaacacaccgccgaaaaacccaccgcacttcggcttttctcccgaactgctcgctatttggcgattgcttgccaactcggaaacggctttacattgacctgttgttacatcgtattttgttttgaagattttgttcatatatctattctctttaaaaatggatttttaaattaatgatttctttcgttgattgattgtttagtaaactttgtaggaattggttataagcctaaacaggaaatgccttgctttttaaggcacagcagaaaaaggcgaatgatatcttcactaagggttttaaaagggtagattggggtatgacgagaagttaaaaactttttaaaatttattttgcaaggtttataaaaaggcgttagcctaggctgtaggctgtaggctgtaggctgtaggctgtcatttttctattctatttttgtttgtcaagtaaaaatccggattattctatctcaaaatttttatggaaaaaacaattttcttacgtttttattctaattcagagggtgatttttaattacgttgtttgatgtcaaagcgaaatttaatgaaaatgaccgcacttttgggcacaacaaaaatccctattgggtgagacttcaatagggattggctgtttttaaattatggcaggaatactattttttccaattatattcaggattgataatatcttctatttcatgccaataagcagttaatacgacattgccataagcataagcccgaagtgcatagggcggataaacaaagtttattccttcattattgaagtaaaattgttctgaaatgttgaaatcttcttttgtgatcataccaatatagtcatcattcgcttcttgcattagattggtataaaagctccaaagtacttctttcagcttggtttgttggtcttgctgaatgatgtcgtttacttcaagtattttctttttatgactatcaatattctgatatagggttacatttatgccgtgagcaccaccggtataagtatcaatatcgttactgaacgtaatgatattattgcgttgccctagataatttgatgttagatggaatgatgcacctaatacacggtcttcttttgcactttgaacgaattcatcatgaatttgttgaaatttttgtacaagatcttgttttgtcggcgtgtcttttttcatgctatcttcaccgcccactaaggtataagcatgtttgagcaataactgatcaagccattttataccggtttcggataactcaccacgaacttcaatttgtgcattgtcagtagtatattcatcggaatgcgggtaatttacggtttttacttgatcaaagataacatttttcttgacttgtaaagttggaacgtcttgttcctgacaagctgccaatagaacagttgtcataagagagaagaataaaaagatttttttcatatgattgccaaagtttagtggagtaagaaagtctttattataagttggcagagtatgaatgtaaatttttcttttgggtaagaataaatcgatatattaagtcgctattcttccgtataatacgggttttatttagatagaacgcaaggatattttatgaagcaaactactcaatcgatgaatatagtcgatatgttgatcgttacagtgatcttttttggcatgccgatttatacttctctgtcgcaatttttcttattgcaagaaggtgcggtcgcaattacagacacgttgacatttacggatcaggataatatttgggcaattttgatagaacttatctcattagcgattgctgcggtgtatttaaagataagacgctttgattttacgcagcttaccttttcttttaacgctaaagcgattgtgctgaccgcagggataattttgattgccggcagtctcagcgaactttatttctatttggcagctccctttcaagatgccggtgcatatctcacctcggctgaggttgcacttacagatacaacatcgaccttatctttttacctcgtcctcttttcattgctcaacggtttttttgaagaagtcttttttctcggcttgatatttgcagtaaataaaaaagccttgccttatgcgattgtgttcagtttggtcatccgttttttgtttcatacctatcaaggtatgttttatgcagtaaacgtattgttattcggtatcgtattgctaatacttcgctctaaaatcaaaaatttattaccgtttacgttagcacatgggttctttgatatttttggattgggattgttacccattattgatattgtcgaaaaaattatcaaataaaaaggcgtattaaatacgcctaaataaacaatcggataaccgttagaaacggtagttaagatttaaaccgtacaaattggcacgtgccgttgattgataatccgcacttatattaacgagtttaatctcttttccaatattttgtgtttcgctaaattgctgttttttacctcgtaaatgagcaaaacctacgtcaacagaaagatttggcgtaaagttataggttgcccccaagctataccaagtgcggtcggtatcggggattgaagcacttgggtggtcggctgactcatcataagcaatacctgcacgcagggttaatttatcattcacattataagtcgcccctagagctacacgtgaactgtcatgaaatttttcatctttatggaaagcgaccttgccgttatcataagtggcatgtaaactttgtaaacggctccatttagtatatttatagctgtagtgcatggcgaatttttccgttaattggtggaaaccggaaatttcgaaataatccggcaaatgtagcgttaacccacctttctctttaacaggactaatttttcctgcttcaaattgataactcaacgcatcatcatctttaaaattaatatctactttagaatgrtaggcaataccgatacggttaccttgattaaattcatagactgccccgatattccaaccaaatccccatgcattattatcttgtaattgtgttaaggtggtatccgcattgacttttatttgagctaatgcagcaagcagttgttgtgatgacggatccaatctgattataannnnnnnnnnnnnnnnnnnnnnnnnnnnnnnnnnnnnnnnnnnnnnnnnnnnnnnnnnnaaaacacctgcttgtcgttcaattttcgctttggcataaaccgcattcaacccagcaccgatgcttaatcctttgctgatacggtatgaaccgcttaaatttaagttaatggaattcagtgcggtggttccacccaaaacaccggcatcataatcctttttatatttactttgtaacccaaagttcacattcatgcccgcgccgacagcaaatttatcattaataggtgcgacgaagtacatattgggaataactgcacttggcacaatgtttttctgatccccttttccagtttcaattccgtgaattctccccgcattaacattaacctcaccatttatattaattctagattgaacgtataccccccccattgagaattgtttcgttttaaacaaactcattaacgctgggttggttgccacaacagcggcattatcagcaatcgctgcctcacccgcataagctcgtcctaaaccggaactggacacctcagcaatttggaacgccgccgcattaacgtaacttgccgataatgccaatgctgaagcaatgaaagatttagtaaaaagtgattgtttattgctattcattttttatttaatacctctatatatggtgaagttaaatttcccgaattctaaagtaagagtagtatcgggacaaatgaatttactgatttgttcagtggtcataccaggcggaaatctttcatttactaaagtttataagaagaatttagctgtggcagacaataaatcagtgagttctagttcctcattttgtagaatgttaaaaactttttattgtgttttttgggggaagttataaagattgggtaaaaaattgtataattctttataaataacgcaatataatgatttaatgctaaggaaataggaatgacattgtacaaaatattggtgaatagtatcgctatgatttgttttagcgtttcccttgtagcacaagcaaaaataacggtttttgccgctgcttctatggcaaatgtgttagaagaaattaaatctgaatacatcaaagtaaatcctcagcaggaaattgatttttcctttgcttcttcttctgtcttagcacggcaaattagtcagggagcacctgcacagttgtttatttctgcggatcaaaaatggatggattttttagcggaaaagggggcaattgtgacagaaagtcgtcgtgatttggttggtaacagattggtgatgattgcacctcaaaatagtttgattacctctgttgatttgcctaacgctcaatggcattctcatttgaataatacttatcttgcagtaggtgatcctgagcatgtaccggcaggaaaatatgcaaaagcggcatttatctttttggggcaatggcatgatttagaaactaaattagctcgtgcaaataatgtgcgtgcagctttagcattagttgaaagaggggaaagtccgttgggtgtggtttatgcaacagatgcggcggcaagtaaaaaggtcaaaacagtggcgatttttcctgaaaatacgcaccccgcgattgaatatcctatcgctattgtgaacgggcaagataatgaagaaagccgcaagtttttggcttatttgcggtcagaaagtgcggtcaaaatttttcaacaattcggtttttcagtgaaataatttttatgttagatgtgataatcgattatctacgtttatctcaatctgaaatcaatgcaatctctttgagtgttagagtggcattggtttcaatttcggtgagcttaccttttgctattgctgtcgcatggttgcttgcacgcaaagatttttggggtaagtcgattattaacggtcttattcatttaccgcttgttttacctcccgttgtaattgggtatttattattaattgctatggggcgtaacggtattatcggtcgctatttactacagtggtttgattttagttttggctttagttggtacggtgcggcgttagcttctggaatcgttgcatttccgttgcaggttcgtgctattcgtttggcaattgaaaatattgattttcggctggaacaggcggcacaaacgttaggtgcttcttcattgcggatattttttactattacgttaccgctttcattaccggggattttatcaggaatgattttgggttttgcacgatctttaggtgaattcggtgcaaccattacttttgtatctaatattcctcaagtgacccaaactattccgctggcgatgttttcttttattgaaacaccgggtgcggaatattcggcatttagactttgtgttatcgccattattattgcattgatctctttgtcaatttctgaatggctggcgaaacgaatgcaacaaaaattggggtaaagatacttgtaattataagcctgtgccgagtgatgctttagcggtaatttttgattatttattttacaatcgttcatcatttcctgtatgaggctttatcgtgtcgttatttctatgtgctgaagaaagattagtgcaatgtgcaacttctttaattgaacagtttcctgagcaatacaacactacactttttcaacaaattcaaaaagataaacataatcaaaaaacgcaactcgggcaattaggttatggattatatttatcagattttgtgtttgaaactttgcaaaaacaaccgcactttctcaaacaatgttggcatcaactccctactttagctgattgcgatcgatatttcgttcgcttacaggaaatactgataaataccgaaacggaagaacaactgtaccgcaagttacgtctatttcgtcatcgtgagatggcaaaacttagcctttgtcaaagtttaaatttagctacagtagacgaaatttttattcggctttctcaattagctgaaagtttgatcattgccgcaagagattggctgtatgaaaaaatttgcacagaattggggacgccaacggatacacaaggcaatcctcaacaattatatattttgggtatgggtaaattgggtggatgtgagttgaatttttcttcagatgttgatttgattttcacttatccgacaaatcagggggaaacacggggaggacggcgtagtattgaaaatggtgtatttttcacaagattgggacaacgcttaattcgtgctttagatgaatatactgttgacggttttgtatatcgaacagatatgcgtttacgtcctttcggtgaaagcggtgcattggcattaagttttaatgcgatggagcaatattatcaagatcaaggtcgagattgggaacgctatgctatgataaaagctcggattttgggagcaaatatgcaagatccgaatgtaaaaatattacagcaattattacgctcttttgtttatcgccgctatattgattttagtgtgattcaatctttacgtgatatgaaaaataaaattgctggtgaggttcgccgtcgaggattgttggacaatataaaattgggtgccggcggtattcgagaaattgaatttattgtgcaggtttttcagcttattcgtggcggacgtgaaattattttacaacaaccatcgctgcttcatcttttacctgcactggaaaaattgggtttaattgataccgagcaaagcacaaatttatatcatgcctatttatttttacgcagagtggaaaatattttacaagctattgatgataaacaaacgcaaacgttgccaagtgcggatatcgatcgtgaacgtttacttcttgctacaaaaaattttacctattttccgctattgacggaagctacacaaaaagaaaccgcacttgctcaatatcctattgaaaattggcaacaatttttacaggtattgcatgaacatcagcaaaaagtgcggttcgtttttcgaaatttaattggcgaagatgacgatgaggaagaaaaaaatattgctgatgatctgtggcacgactttctcaatgctgagatcaatgagcaagaaattaaagtcatattgcaggaaaatcaaatagatgagcaatattttgatgaaattattgaaaaattgacacagtttaaactggatttatctcgtcgatcagtgggagaacgtggtcgcagagtattaacgcaattaatgccaatgttgttccgtcaagtatttcgatacaaacattctcagcaacttttacctagagtcttgaaaattctggataaaattatcacgcgtactacttatcttgaattattggtagaaaatccacaagccttaactcagcttcttaaattatgtgcacaatcaaaaatgattgctgaacaagttgcaaaatatcccattttacttgatgaattattagatcctaatgcactgttaaatcctacggattttcatcaatattcatctgaattacgccgctatttacttcgtttaccggcagacgatgaagaacaaattattaatgggttacgccaatttaaacaaaccgccttattacgtgttgcggcagcggatattttaggggcattacctgttatgaacgttagtgatcaccttacctatttagccgaagcaattatcgaaaatgttgtcaacctcgcttggcaacaagtcagtctaagatttggtacacctgaatatttgaaggaaaatcaaaaagggtttttggttattggttacggtaaattgggcggcattgagcttggttataaatcagacttggatcttgtttttctctatgacggaagtcaaacaggacaaactatcggcggtaaaaaatccattgatagcaatcagttttatctgaaattggtacaaaaaataattagtatttttagtatgaataccagtgcaggaatactttacgacatagacattcgtttacgtcctgccggtgatgcagggttattggggtgttccttaaatgcctttgaaaattaccaactgaatgaagcgtggacttgggaaaaacaggctttagttcgttgtagggcggtatacggcgatattgatttatgtgaacgctttgaaaaaattcgttgtaatgtgctttcagctccaagaaatgtggaacagctgaagcaagatatacgagagatgcgtcaaaaaatgtatcatcatctctctaaacataaaacggacgaatttaatattaagactgatttgggcggtatcacagatattgagtttattgcacaatacttagttttagcttatgctccccaacattcagcattaacacgttggtctgataatgtcaggatatttgactgtatggctgaaagtgcggtgatttcacaagaagtttccacaaagctaaaaaaatgctatgtaaatttacgaaaccaaattcatcatttaaatttattaggtcaagaaccgattattaatgcacaactatttagcaaggaaagaacgtttattctcaatacatggaaaagtttattggaatgaatgaacttataattgccctaaaatcagcatatgataagaaattatttatcatttgtattttctttgttatgctatgcagacctttaacttacattaacaaatgagaaataaacgatgaaattaaataaatcacttttggtcggcacattagtcgcctcaactgtattattagcagcttgtaatgaaaaaaataaagcggaaacaacgccaactgaaccggttacagttgcagaaactcaagctcaacctgacgttcaaggaaaaactgaaacaacytcrwctgaaycaaccgcarytgraaayacacaayctgawkctcaagaaaaagttgtttcagaaaaaagtgagacagttgaacaagaaattcttaatcagtttaacaatacagttacgatccaattggtggggtatcagagtgaaaaaatagagggtgaagatactttatctttcgtttataacgttaagaataaaggtgataaagcaatcaaagaacttcagtggtataaccttgttttctttaattcgactctggtagagcctctttcaatagcctattcttttgaggatacgcttgctccggaaggcgagggcgaaataaaattaacaaaattagctaaaacttatgctgaagagattcgtgcagatatactaaaaccggaagctaatcttcaatttagcccaataattgcaggtcgaattatttttgaagacggtacgcaattagttgtaactacagatgaagagcttactcaatctttacagcaaattttaacgcaataatttttaaaaataattattcaacgcattagttatctatccgctcttacaagctataatatttataaataactacaaaaagttatcaataagattttatagattggtaagatcggttatgtttccgcatcgaaatctactgcccattattggcgaaaccgaaagaaattcgtcgtaaaaagcgtgcagagcaacaagaaaaagaagtgtgaagaaaaaaagctgagaatttgctaaaaatcagctcaacaaaccgcactttaataataaaaatttctgcgagaaatcatgtaaaaaaaataacaccctcttaacaagaagagggtgaataatcaatttaccattggtaccctatagaaactgaacctgccattttgccttgagaatttctatttccttgaaatttaagcataatcttaccgttatcactcatacgagaataaccaatcgccattgcgttttctccgccataacctgctgcagaaatggctaacatagatttacccggcatagagactgatgtcaaccctgccgccgcatttgcccccgcaattcctgcacgtaaatttcggtcagtattattcaattgtgtacgcaattcattatttttaccatccacatagtttttatttaccaccgcacttccagtggttgttggtttaatatccggcacggtaataatacctttttcaccatcgattttaatttcaccacctacacctttaacagttaagccttttgcaccataggtagcagtagcagtagcagtcttatctgttacagttaagctatcgctatttaacgtcgatttcttaccgctctcctctttggtttcaaaggctttcatatttttcaaagtatcggacagttttatttctaaaccatcattagttttattggtttctaccttgatattaccagcggcactactaaatgaacttgcagtttgaccgttttgaatttcctcttcccctttaataattaaggtatcgctcagttttctatgaacaatcttatcattcccactctcattcccagcaaaactcaaccctgcttgtgcaaccgcttttaaatcagcgagattggcggctttgtgtagttcatcttttgtcatttgttgcccttgctgaccgctcataccctcagcaactaattttttcactagctcaagcgttttatcttgtcccattggttgatcttgagtgccattatcaagccctaaaccggattttagatttttaatagcaacaggtggagaagaagtactactactagtttgagttccacctaaagtgatagtatctttcgttttactatcatatttcaccgcaatttcatccgcttctgcctgtttatcggcgatggtttggattttgtttttcacaaattttttcaccgcaccggcagtcgtgagttttttgtcttcagtatcagcatcctctttaatatcttcagtcgcttcaatcttaaaggaaatggtgcctgtattcgcatcaatactcggtttgatatagtcatcaccttttaacttaattgtcgcaccaagttgacgtgtcattttgtttgctgtggtactaccagcctgatctgtagacgttgtagtactactagcgtccacttcaaaaattaaacctttgttaatggtttcgatgtttttatcaatagcatctttgaaagtagctgcggctttgacagattyrtcatcaccattttcatctttcaatttagcaaaagttggtgctttaaacgtttttgtttggtcatcaaccttagcccctaaaatatctgtccctaattttccaaagacttcaatcacaccataaagctgtccgccattaatcgcatcagttgaaccggacatcacgctacctgcggcaacgtgagtaataatgcgttctgcacctgtattgcccacactgacgaccgaattacactgcccatttttagaagtacctgccactttccaagtaaatgttaaactatttttacctacattaatgtcagtagttttaaatacgtttttcttcgtttccaatttagaatttttccccaaggcgaaagaatcatcatcggctttgttgctaagttgaataatttccaatttatctgttaccttttttgccaatttaagcgtaactttttgttgtttatcttcaaccgctgtttcaatctcatctgttgtgcctaatacttgcaaggcttgcgatctgagtttaacckcagcttgaggttgtccgcttgcagatggcgtacctgagggctgtggtggttgcggttgaggttgtgcttgtgccgtgttggaattatccgcttcaatttttagcgttaatgaatccaattgagttttcaagtaatttttaaccgcactcaccgttactaatttattgccattcgggtcggttgtactacctgaaccccccatgccttgaccattcgtatcaattgaattagccacattaagtttaaaggtgattttgcctccattgttaccgccactgctactttctgtcgccaatatgaggtatttatcgcctttaaacgttaaggtttcgcccagtttacgaatgaaaggattttttccgttttgtgctgatggttgagttgtacttccatcatccaccgcaaacttcaagcctttttccacaagggctttggcgatgtcggacaagtctttcacattgacagcgttgttggaaatgttactgccattactaccaagatttccattgaggacattttcaatattgctagttccgctacttccgccattgctatttacccctaaaccacttccaagtttagtgatttgtttattacctaaatctaagccgtctttgccaaaggtaaatgtgccagtgcctgcggtgattttgaccgttggactagttgggcyaccgctaccattcgtaaattcaatttttgcaaccgcacttccgttacttccgctaattgagctaatacctttcaactcttcattcaaagcaatttctagtgtgtctttgcttgtttttgtgaaaatattttgatgggtatttgttgcaccattttgccccgcacttgtcgctgggcttgaagcatcgcctttcgcccctttaatgttcaaggttgarccgagatagagttgttgctcgctactgcttccannnnnnnnnnnagtatcacctttaaacttcaagccctcattgagtttggcgatgtttttatcaatcgcgtctttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttgtccgccgttaatcgcatcggttgaaccatcggcaacattacctgcggcaacgtgggtaattagacgttcggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaatttttccccaaggcaatggaatcaccagcggcgttttcaactttcgcaccttccccaatcgctaccgcacctgcggctttggtttcggcatctttaccgatggcgatagctcctatggcacttgtagcaaccgtcgcttttttccccaacgcaatgccgtaatcggcttcgactttggcaacgctaccgatgaccaccgcggctttccccgaggctttggtnnnnnnnnnnnnnnnnnnnnnnnnnnnnnnnnnnnnatcatttgccgtgccgataacgatactgtacatgcctttgctcatttccgtttccgctacgccaatggctaaagaatgatcagctttagcaccatcgttgtttttgtttgtttcagcctttaagttagtgacagagaaataagtgacaccgccaccgccggcatttttcatcgcttctcgcaattgtcctaaattgacggcgtgggtatcttccgtccccggtgcgacattcacgatttgacggtattttgtatcttttttaccgattgatagtgcaccgccgagtttgtttttgaatttatctgcaaactcttggcttatccatgtttttttttcagcattactctgatcatcttttgtaatcataaaagtgccatttcctgaagggctatcggcttcagattcagcacccaaagcgattgcatcggtatgttgattatccactctcgccttgtaaccaatagcgacggctttttgagattccacagaagaatgtgaacctaaggcggttgaatttgaaccttttgcataagcacgatgccctaaagcaacatcgtcagtttgctccgcataagattgcatacctagtgctactgtttcgctaccataggctatggcttccgaacccaatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcgtttagaattgtatcgggtccaatttttgattcgttagctgttaaaccactcaaaactatattaatatcctgaccatacacaaaactcccagtcaataaaaacgccaacggcagtaatttaaacagccctaaaaaattgcccgaaatcccaccgcactttggtttattttcagaacggctcgccacttggcaatttttcgccaattcagacaccactttggtttgtccagtggttatatcgtatttggttttgaaaatcttattcatggtttactctctttaatcttttaaaatgggttatttaataatttattttgttgatttttttcacttttttatggttgtgaatggattaaactttttgttttttaggtagattaatgaggtataaatcggcgatgccttgctttttaaggcaaagcagaaaaagacgaatgatattttcgctaagggttttaaaaggggaaatttgggtatgacgagaagttaaaaattttttaaaatttattttgcaaggtttataaaaaggcgttagcctaggctgtaggctgtaggctgtaggytgtaggctgtaggctgtcattttttcttttctattttatttgtcaagtaatcattaagcagtagaattttgcgattctatcctaaattttattaagaatgaaatagttttttcattttttttgtttcgatctcgattatatagtgaatcaagatgtttgaggggaaagataaaggcggagtttggctttttttgggttctaattacaggttatgttttggcgagattgctatataatgtcgaattatcttaccgatttatcaattttcttttctttgggagtaaaagatgactcaagcgaagatttattccgtttcacaacttaaccaatccgtacgccaaatgttagaagggcagttgggggttgtttggttgacgggggaaatttccaattttactcagcctgtttcggggcattggtattttagtttgaaagacgaaaatgcacaggtgcgttgtgcaatgtttcgcatgaaaaatatgcgtgtcggttttaaagcacaaaacggaatgcaggttttggtgagagcttccgtgagtttgtatgagcctcgtggtgattatcaattgattattgagtcaataaatcttgcgggggatggcttattgcaacggcaatttgaggcgttaaagttaacattggcggctgaagggttgtttgcacaacattacaagaaaaacttaccgcactttgcaaaatctgtcggtattattacgtcgcctaccggtgcggcgttgcaggatattttgcatattttgcaacgtcgagatccgagtttgcatgtagtgatttatccgaccgcagtgcaaggcaaagaggcaacggcagaaattgtacagatgattgaattagccaatcaacgtcgggaggttgatgttcttattgttgggcggggtggcggctcgttagaggatttatggtgttttaatgaagagagggtggcaagggctatttttcattccgagttgccgattattagtgcggttggacatgaaatagatgtaactattgcggattttgttgcggacgtgcgtgcaccgaccccttctgccgccgcagagcttgtcagtcgtcatcaacaagagttattggatcaattattttatcgtaaacaacgcttggaaatggcgttggatcgttttttccaacaaaaagtgaagttgttacaacgactgcagtttcgtttgcaacaacaacatccgcaaagtcaattaaatattcaacaaaaaatgatgcaacaattacttcatcgtttacatcttgcgttaagtacttttgtcgataaaaaacagcagaaaatgaccgcactttgtcgtcgtttagataattcacctttgccttattatgtgcaaaaacagcaccaaattttggttcaattggagcttcgtttgaatagcggattacaaaaaaaattcaaaaatgccgattatcagcttagtcgattatgtggaaaattagacagtttgagtccgttgaaagtgttggctcgtggttattcgattacgaaaaatcagcagggacaagcgttgaaaaacagtcatcaaattgaagtcggacaactgattaaaacgcaattagagcaggggattgttgttagtcgtgttgaggaagtggcgcattgaactaaaggagcaaacaagtttgctcctttagtttgtgtatggattggggtagttaattgcgtttgccgaaaatagccgttccaattcttaccatagttgaaccgcacttgatcgcacttgccatgtcatcactcattcccattgataatgtatcaattttttcatcaggaaacgccatttgtagttgagtgaataaatatttcatttgattaaatgcttgttcttgtgcggtgatattatcagtcggttcaggaattgccattaaacctcgtaggcgtaagtgcggtagattttggatatgttttgccaaactcaacatttcttgaggttgaatacctgatttgctgttttcagcactgatattaatttgaattaggacatttagtggttgtttatagtgaggacgttgttcatttagacgagtagcaattttttcacgatcaagcgtttgcatccaatcaaagttttcagcaactaattttgttttgttggattggagcggtccaataaaatgccattcaagttgaatatgttgttctataaaatattgaattttttccacaccttcctgcacataattctccccaaatgctgtttgccctgcctgataagctatcagaatatcctcgaccggtttggttttactgactgctaataaggatactgtggaagaatgtctttttgcctgttcgcaatattgagatatttgtcggtttattttcgctaaattgttttttatttgcatcataatgagcaagacctgttgaagttggtttgatatgggcattattttaccttaattattcgacagggggaaatttatgaaaaatttttcattttctatttgacaatagcataaaatttcggtatttctaacgcactcttttttgattttgaaataaccgaatgtataaccgcactttttctattaccacgatgattattaccattaagatgattaatggcgtgggctagtgcataaaaaataggatttacaaagcccgcctcgtaaaaaagtgcgggtttttttattaacgtttttattattaaatcttcacaacatataaggaaaaattatgcgagtactcaaatttggcggcacatctttagcgaatccgcaacgctttttacaagcagcagcacttattgaaaaagcacatttagaggaacaagccgccggcgttctctctgcaccagcaaagattaccaatcatcttgtagcactttctgaaaaagccgctttaaatcaacctactgatggtcattttgatgaggctcttgagattttttataatattattaatggcttatatgcagaaaatactcattttgatcttgttggcaccaaagcattaattgagtcggagtttgcacaaattaagggattattagaaaacattcgtcaggcgggaaaagtagaagatgcggtaaaagcgacgattgactgtcgaggtgaaaaattatctattgcgatgatgaacgcttggtttgaagccaaaggatatacggttactgtgattaatccggtagagaaattattggcttatggctcttatttggaaagtagtgtggatattgcggaatcaactaaacgagttgatgcaaaatctattcctgctaaaaatattgttttgatggcaggctttacggcaggaaatgataaaggtgaattagttttattgggacgtaacggatccgattattcggcagcctgtttggcagcttgtttaggggcaagcgtttgtgaaatttggacggatgtagatggtgtttatacctgtgatcctcgtttagtccctgatgctcggttactttccagtttatcttatcgtgaagcaatggagctttcttattttggggctaaagttattcaccctcgcactattggtcctttagttgagccgcaaattccttgtttgataaaaaatacgggtaaccctgaaggtgcaggatcaattattgacaatcgtgaaaatatttctgaagggctacaggttaaaggcattactaatttagataatgttgctatgttcaatgtatcaggaccgggtatgcaggggatggttggtatggcagcgcgtgttttttccgccatgtcaaaagccagcgtttccgttattttaatcacgcaatcttcttctgaatatagtattagtttttgcgtaccgactaaagctattgaaaaggcaaaagcggcactaaatgctgagtttgaacaggaacttgtcgctaaagatcttgatcctgtggaagtaattcatgatttgtcaattatttccgtagtaggtgatggtatggagcggtctaaagggattgccgctagtttcttttcggcgttagctagtgctaatatcagtattgttgctattgcacaaggctcttccgagcgttcgatttcagcggttgttcctttgaataaggcgattgaagcggttaaagcaactcatcaggcattgttcaataatcgtaaagttgttgatatgtttttagtcggtgttggtggggtcggtggtgaacttattgaacaaattaaacggcaaagtgaatatttggcaaaaaaagatattgagattcgtgtttgtgcgttggctaattcgaataaaatgttgttaaatgaaaatgggttaaaacttgataattggcgtgaagatttggcaaatgcaacgcaaccgtcagattttgatgtattgctttctttcattaaattacatcatgtggttaaccctgtttttgtggattgcacaaccgctgaaagtgtagcaggattatatgaaagagctttgaaagaaggctttcatgtgattacaccgaacaaaaaagccaatacccgtgagctggattactataaccaagtgcgtgaaaatgcacgtaaaaatcatcgtaaattcctttacgatactaacgttggtgcaggattgcctgtgattgataacttacaaaatctattagccgccggcgatgatgtagtgagttttaacggtattttgtcaggatctctctctttcattttcggtaagttggaggaggggctttctctttcagaagctaccgcacttgcccgtgaaaaaggctttacagaaccggatccgagggatgatttatcagggcaagatgtggctcgtaagttattgattttggcacgtgaaatcggtttagaacttgagttgtcggatattgaggtagagggcgttttaccgcaaggtttctcagagggaaaatcagcagatgaatttatggcgatgttgccttcattggacgaagaatttgcagaacgtgttgcaaaagcaaaatcggaaggcaaagtattgcgttatgtaggacaaattgaagaaggcaaatgtaaggtttctattgttgcagttgatggagacgcaccgttatataaagtgaagaacggtgaaaatgcgttagctttttatactcgttattatcagccgattcctttgttattgcgtggttatggtgctggtaatgcggtaacggctgccggaatttttgccgatattttaagaaccttaaaacattaattggagtgataaatgttaagaatttatgcacctgcatcaagtgcaaatattagtgttggatttgatacattaggggttgcagtatctcctattgatggttcattgttaggtgatgtcgttcagattgaagaaattgaacagggatttgaactggaaagtacggggtattttgtgcgtaaattgccaaaagaaccgcaaaaaaacattgtttatcaagcctatgtgttatttagtgaacgtttaaaattacgcaatctgaaaataaagccgttgcgtttaacgttagagaaaaatatgcctattggctcgggattgggatcaagtgcttgttctatcgtggctactttagtggcgttaaatcaattttatcagcagccattttctaaaatggaattgctggaaatgatgggcgaactagaggggcgaatttcaggttcaatacactatgataatgttgcaccttgttatttgggcggtgtgcaattgatggtgcaatctctaggtaatattggtcagcaattacctttctttgataattggtactgggtattggcttacccgggaattgaagtttcaacggcagaagctagagcaattttaccgaaaagctatactcggcaagatgtgatttctcatggtcgtcatttagggagttttgtacacgcttgtcatactcggcaggaagcattggcggcttatatgatgagagatgttattgcagaaccttatcgtgaagcattattgccaaattttgctgaggttaaacaggcagtgaaggatttgggcgtacttgcttcaggcatatctggttcaggtccaactatgtttgcgattgctccggatttagctattgcgactaaatcggcaacttatttagaaaacaattatttacaaaataatgagggctttgtgcatatctgtaaagtggataatgtgggtgcaagggctttagtttaacgagaacaagttatgaatttatataatattaaacatccggaacaacaagtaagtttttcacaagctgtgcgtcaaggtttaggaaaagatcagggcttattttttcctgaaaaattaccgcactttgacgacattgatagcctcttatctttgcctttggttaaacgcagtcaaaagattttaactgctttaattggtgcggaattgtcacaagaaactattagtgcaatggtaaaaaatgcctttacatttccggcaccgatggtcaaagtagaagataatatctatgccttagaattattccacggtcccacgttagcttttaaagactttggaggacgttttatggcacaagccttagcagctgtgcgtggagacagtaaaattactattttaactgctacttctggcgataccggtgctgcggttgctcatgctttctatggcttagaaaatattgaggtagtgattttatatccaaaaggtaaaataagtccgttacaagaaaaattattttgtacacttggcgggaatattcgaactgttgcgataaacggtgattttgatgcttgtcaagcattggtgaaacaagcctttgatgatgaagaacttcgtcaagctgttggtttaaactctgcgaattcgattaatatcagtcgcttgttggcacaagtttgttattattttgaggcggttgcacagttaccgaaagaaatccgtcaagacattgttatttctgtgccgagcggtaatttcggtaacttaacagcgggattaattgccaaaactttaggcttaccaatcaaacgctttattgcggcaaccaatgccaatgataccgttcctcgctatttgaatagcggaaaatggcagcctcatacaacggttgcgactctttccaatgcaatggatgtgagccaaccgaataactggcctcgtgtagaagaattatttaaatgtaacggctggtctttaagtgaattgggttcaggtgcattgagtgatgaggaaacagaaaaaaccttgcaggcacaatatgccaaaggttatttatgcgaaccgcatggggctattgcgtatcaggtgctaaaagatcaattacaggttaatgaaacgggtattttcctttgtacggcacatccggcaaaattcaaggaaaacgttgagcgtattttaagtctcgagcttgtgcttccggaaacattggataggtacaacaagttgccattgctttctgatgaaatggaaaatgacttcgctcaattacgtgcttatttattaaaaaaataaagcattttaaattaaaagtgcggttgaaagtcggaaagtttcgattttatgtacatataataaaagagtgggattcccactcttttgtttgctgtactgtttttttagacaagaaaaacttttaattcgggagcttatgcctcttattttcttgatagacttgcttgaattttattttttgccactttcatcacagttttgtacattgctacattttccgtaaagatacagattgtgtgtttttaatttgatgccatgttccgcactgatttcacgttggcgtttttcgataacttcatcattaaattcaaagactttgccacaatcgacacaaataatgtgatcatgatgttcttccggtgctaattcaaaaacagatttgttaccttcaaagttatggcgaataagaatatttgcctcatcaaattggttaagtacacgataaacagtggctaaaccaatatctttaccttgttccagcaacattttatagacatcttcggcggagaaatgttgcattgtgcctctactttcttgcattagagacaaaattgttaagcgtggttctgtaatttttaaacctgctttttttagtagcttgatattttcttcagacatggtagctcctcaaattttatgccagttcagctaaacacatttcgtcatacacttgtttaacccatttttctacacgttctgcggtgagttctggttgacgatcttcatcaatacataaacctacgaatgtattgtcatcaactaaggcttgcgagacctcaaaagtataaccttcggtcggccaatgcccaacgataattgcaccttttggttcgataatattgcgtaccgtacccatcgcatcacagaaatactctgcatagtcttcttgatccccacaaccaaaaatagcgactaatttatcggtaaaatcaatttcttctaaggttggaaagaaatcgtcccagtcacattgggcttctccataataccaagttgggataccgatcattaaaaaatcatagctttcaatgtcttctttactacttttagcaatatcacgaatatcaatgagttctgaacctaattgtttttgtatcattttagcgatattttcagtattacccgtatcactaccataaaataaaccgacaatagccatttttatctatttccttgaattttaaaataatcttttaagatcgttataattaactctcaatgtctaatcgcttgttcagacgcctgacttctaactgctgaactaaatccgcatgtaacttttactcaatacgttttaaaatgctaaatttatcgcattgaagttgattacatttgtttattcggagctgttgttcatgaagcagtgaatttgttctaggcgtcctactttgggaagcgtcgcaaacagatttagtgtaatacaatctgcatcttgtttagccgttttcaaaccactgaaaatatatcaattctagcctggttctaattgagaatgataagctacaagcaaaatttgaagcgaactataacacaatttatgagtgaattaaaccctatagatcaagtaaacatgagaatttttatgacaaaaaacgctgaattgatctaatcacaaaatctgctttttcagcatgtacccaatgcccactttcattgatggtaaaagaggtcgcttgtggaaattgagcgagaatttgttcactgtattccggcaaaatgtaattcgataatccacctcggataaacagtgttggtttgttaaaaaatccttttttccaatccatgatttcagcgtaattttgtttaagtgcggtgagattaaagcgaaatttttcttttgcttgtgcatcgaaagacttgagcataaattgctgtacgctttcttgtggaatatagttagccagtaattgttttgcttgttgacgagtttccgattgtgctttacttacggcaaaaagtcccgcaaatacactgttgtgttcattgttgctataattgaccggtgcaatatcaatcacaatgagcttttctattaagtgcggtcgtagcattgcacatttcatcgctgtttttccacccatagaatgcccaattaaaataacgttggttaaattcaaatgatcaatgacttgtagaacatcttccgccatcagctgatagttcatttcttcactatgaaaactttgtccatgattacgtaaatcaagacgtaaaatagggtatttttcggaaaaagcacgagcaatgacaccaagattattcatatcaccaaataaaccgtgaatgaaaacaagagtgggtgagatttgcgagttgtttatagcgtgaaattggtaattgagtaatttagtcgtgggcataatttttgcgtgtgtatttgtaaagaaatcgttataatgtgcgaaaaattcaaatagatcaagtagaaatctcttgtaggcttgtaatgtaaaaggagttcggttatgaaaattattgaagttgacgaagagctttatcagtatattgccggtcaaacgaagtctatcggtgaaagtgcgtctgatattttacgccgtttgttaaatcttccttattctaacgtagcaagtgcggtacaaaattcggaaaatgtatctacagaagcgattttaccaaacacttgtatagaaagtgaacaggaagttcaaacgaacgaattaataaatattcctgtcaaaaagcagtctgatgaagctattcagaaaattgttgataaagtaagaaatcttttatattcagaagaattccagcaagaaacgaaagctgttgtgcgttttttgagcttgttgcgtacactttaccgcactaatccggaaagttttgcattggcaacggaaagtttgcaaggtcgaacaagagtttatttcgcacgtgatgaggctactttactggtagcgggtaatcatacaaaaccgaaacaaattcccgacactccgttttgggtgatcactaatactaatagcggtcgaaaaatgttgatgttggaaagtgcgatggaatctatgcatttaccacaagaacttattgaagaagttagatctttttttgtgacgaattagcgatgttcttttggcataaatatgcactcactcccttatttcaatcaaaaatagccttgcgaaactcgcaaggtgaagtctttacttggcaacaactttgttctttaatcaatcggcaatctctactttttcagcaacaaggtgttaaagctggttcgggcgtgttgttatgtggtaaaaatgatttttcattattgttggcttatttggcaactattcagttgggagcaagagttttaggtgttaatccgagttttcctgccgataaaattcagcatatcgcagaatgttatcaatgtgattttatttttaataggactgctttcctgtttaaaaatatgcaaaatttgaccgcactttctgcgagcgactgtacgcaatatgtcgatgttttacctgacactgaagttaaaatggatttgcaggctgtggcaactttaactttaacttcaggatcaagtggtttaccgaaggcggttgtacatagtttgcaggggcatttagataatgcgattggcgtttgtgagctaacccaattcagtgcaaaaaacagttggcttttatctttgcctttatttcatgtttccggacaggggattatttggcgttggttggtaagcggtgcagaattgcatttaccgcaagaggatttttatttttctgttagtcaggcaagtcattgttcgttagtaccgacgcaacttcaacgtttattcgattattggcaacaaaatcctactctctcacgttacacagagcatattttgttaggcggtacgcaaattcctacgcagttgactgagaagttggcacaatacagtataaaaagttacaccggctacggtatgacagaaatggcttcaacggtttgtgcaaaattgagtgatggtaaacgtggagtagggcagccgttagcggggcgtgaagtgcggttagtttgtgatgagatttgggtgcgaggtgctggtcttgctttgggttattggcaacaaggtaaaatttgttctttactgaatgaacagggttggtttgccacaaaagataaaggcatttggcaagataatgaattgcacattttaggacgcttagataatatgtttatctccggcggggaaaatattcaaccggaagaaattgaacaaattattggacagaatgaaacggttgcacaggtttttgtattgcccattgatgatgttgaattcggacaaagaccggtggcaatgattaaatttcacgatgttttttctgaacaggcagtacatgaattacatatttggttagcggataaattggaaaagtttaagcaacctattcaatattttccattgctgttgcaatcacaaggaaatatcaaaatttctcgtcatcagttaaagtctgagctaactcgtttattaggaaagtaagtatgaagaagataaaaaataaatttaaacaagttgccatgattggcttattctctttagctcagtttgcactggcaggagcaattttgaccgaaaatgatgtaaagatgcgacttgatgagattaaaaaaatcgaacaaccccagcaagaagataaaagtgcggtgcaaaacttggaagaaacattgtttctcttaggaaaaatagcaaaacagaaagaagacaatctaaagttacaaaaactgattcaagatgcaccaaatgagcaaaagaacatcagagaggaaatcactacattaaaagaggcgtttgttgttcgtgattttgataatttgtccatcgggcaattagaggataacttagcaaaaatacaatccgaattacaacaagttcaagctgatttagtacaagctaatgcacagttagttaatcaacattctgcaacagagcgggcacaaagtgcgttaagtgccaatattgttcgtacacaagaaattgataaattgtcttttagtgttgatattgcacctgaggagcaaaataaattagctacagaaagtgcgttaattgaattacaaaatgactacaatcaaactgtattacaagggaataatgaactcaccgcactttatactttgcaattagaattgaaaaatcttgtccaacagcatttacaagctacgcaaactgcgttacagacggaaattaatcgacgtaaattagtgcaaactgagcaacatgtggagcaactaaaacagattcaaaaggaagcagagggtaatccgttattagttcagcaacaacaaattaatattcagattggacaagatttagtggaacaaacaactaagctgaacgctttgtcgcaagacaatttgcgtattaaatctgttttggataatttgcaacaaactgaacgtaatattaatgaacaaattagtgctttacagggaactttagttttatctcgaattattaataagcaaaagcaattattaccgcacgataggatgattacaggattatcaaatcaaattgccgatttacgtgtgaaaattttcgatttaacggagttaagagatagcctttatgatattgacggttatatttccaatatagaaagaaagcaaggggttacttttggaatggctgaacacgcacagctcagcaaaattttacgggagcgtcagaagggtatttctgatttggtgtctattttaaatgatcaactcaatctttcaatcaatattgaattaaatcaaaaacaagtcaatttaattagtgatactttacaagaaaaactccaacaacaaagtttctgggttaagagtaatacacctattgatttggattgggttaagcgttttccttcactactaaaaatagaattggaggatattcgtacgcaatttaatttcaacaattggcaagataatattatttctgccactgtgttaattgttttccttttatccatcgccttttttatttcttggcgtaaagaaaaaattaagcaacggttgaattatattaatagcaaaattaatacgttacaggaagatagacagctttatactccggaagctgttttttggacgattattctttgtttaccgatgacgttagttgtcttagtcggtttaattgttattacttttatttgttttaatgatcctgaaaaattctggttgtggtcagtaagaatgtcgggttattggtggcttttcgcttttatgttagcgatgttacgcccaaatggccttgcttatcgtcattttagtatgcctaaacataatgtagagcttttttccaatgtgatgaaacgatcagtatggattactgttctttggcttaatgcctctatgtttacttatttagatggaggaattgctaatgatgtgattggtcaattgatgacaattgcggtcttagttatttcactgtttattattggacctcgtatgcgttatgcagtccaagcttatgaaaaaaactcagaaaaaaaacctttcctaaaagttttccgcattgtgttgctactctctcctattattctcattgtgttggtagttttaggttattactacactacgttaaatttgatggatcatttgatgtcttcttattttgctttgatgatatggatagtaattcgcaatatagtgtatagaggatttactatttctgctcgtcgtttagcttatcgtcgtttgcaagaaaaacaaaagaaaacacaggtacaatctcaagatgtggtggacaaagaagagtttaaccttaatacacaagaggaagttttagcaatttcagccgttaaggatcaagttttgcgagtgacggatttagttttactcgtcggcttaatcggtatgttctattgggtttggtctgatttaattacggtagcttattatttggaaggcgtaacgttatggaatcaaaccgccataacagaagttggtacagttattgaaactattaccctgtggaatttgttattagcactgattattttaggcatcacgtatgctttagtgcgaaatattggtggggtattggaagtattaattttttcaagagttaatttttcacaaggaacaccttacaccataacaactttactgatttattttatcattgcaatcggtagtgctatggcattctctactttgggtatgtcatggtcaaaattacaatggttatttgccgcactttctgttggtttaggttttggtttgcaggagatctttgctaactttgtatcaggtatcattattttatttgaacgtcctgttcggattggtgattttgtaacaattgacaatttttcaggaactgtgtcaaaaattagaattcgttccacaacaattatcgattctgataagaaagaagttattgtacccaataaagcctttgtaacagagcgaattgtgaattgggcattgaccaattctatgactcgtgttgtgattggtgtcggtgtggcttacggttcagatttagaattggttcgtaagttgttgttgcaggcagcgtatgaaacacctacggttttaaaagaaccggaaccgtctgcttattttatagcgtttggtgcaagtacattagatcacgaattgcgggtttatgtgggtaaattgtcagatcgtatgactacacaagactttttaaatcgtcgtattaatgaactatttgcacaacataatattgaaattgcatttaatcagttggatgtatttattaaaaatcaaacaacaaatgaagaagtaaaagtactttcagagaatttacaaagataaaaggaataaaaaaatatggcgggaaatagtattgggcaacttttcagggtaacgacatttggagaatcccatggtattgcgttgggctgcattgtagacggtatgccgcccggacttgctttatccgaagatgatattcagccggatttggatcgtcgtaaaccgggaacttcaaaatatactacgccacgccgtgaagaggataaagtacaaattttgtccggtgtgtttgacggaaaaaccacaggaacaagtatcggtatgataattaaaaataccgaccaacgttcgcaagactatggtgaaataaaagatcgttttcgtccggggcatgctgattttacttaccagcaaaaatatggtttacgtgattaccgtggcggagggcgatcttctgcacgtgaaacagtgatgcgtgtagcagcgggggcaattgctaaaaaatatttgcgtgagtattttggtattgaagtacgaggttatttatcacaaatcggtgagataaaaattgatccgcaagtggtagccgatgtgagtaaaattgattgggcgaaagtaaatagcaatccatttttttgtcccgatgaaagtgcggtggaaaaatttgatgaattgatccgagaattgaaaaaggcaggaaattctattggggcgaaattaaccgttgttgctgaacatgtgcctgtcggtttaggcgagcctgtttttgatcgtttagatgcggatttagctcatgctctcatgggaattaatgcggtaaaggcggtagaaattggtgacggttttgcagttgttgaacaaaaaggaacggaacatcgtgatgaaatgacaccggaggggttttgttccaaccatgccggcggtattttgggcgggattagctctgggcaaccgattatcgctaccattgcgttaaagcctacttcgagtattactgttgtagggcgttcagtgaatttaaataatgagcctgttgacgtgattactaagggacggcatgatccttgtgtgggaataagagctgttccaattgctgaggcgatgatggctattgttttattggatcatttattacgctttaaagcacaatgtaaatagaacacataactatgttaagaaaggtaaagttaatgctgaaaactgcggtttttttgaccgcactttttttcactcagatattaagtgccaatccacaatattggcaatcagtgaaacggcctattcatggtgaggcaatgcctataggaagttataataatggctgtcttattggtgcggaagcattgccctttaatggtgagggatatcaagctatccgtactaataaaaatcgttattatggacatcccgatatgattgcttatttgcaacgtctcggtaaaaaagcaaaacaggcaggtcttccaacgattttaatcggtgatattgctatgccgggaggaggacgatttttaaccggacatgccagtcatcaaatgggacttgatgcagatatttggttgcgtttaggtaaactttcggctaaagatgcacaagatccaagtggaatgggactgttggttgttgaccgaaaaaaacagagagtcattgataaattgtggtcaaaagatcatgaaaatctgattcgtttagctgctcaagatccacaggtcagccgaatttttgtaaatcctgcgattaagttgaaattatgccaaacagtaaaaggtgatagaaattggctacaaaaaattcgcccttggtttgggcatgatagtcatttccatgtgcgtttaacttgtccaaaagatgctaaatactgtgaaaatcaattgccaattccggcgggagagggatgtggtgaagaactttattcttggtttaaacctgctaaaccaagtgaatttaagcccaaaaaagtggtgccggaagccccttttctttgtcaacagttaataagtgcaccaaatcgtcatgagtggttagaataggaataatatgatagtagaaattactcttcaactaatgttaattttgtttttggtcgctatgatagccggctttatcgatgccatggcaggtggtggcggtttgattactattcctgcactattgatgactggtatgtcgccggcattggcacttggtacgaataaattacaggcttgtggcggttctttttctgcaagtttatattttttacgcaaaagagcggtagatttgcgtgcttttttgttgattattgtcatgacttttttgggggctgcattaggcactttatctatccaaagtgttgatgcaatcttaattaagaaagttttgcctttcttggttttgattattggcttatattttttattgactccatcacttggtaataaagatagacaaccccgtatttcttatagtttatttgcattcagtatcggtctgacagttggtttttatgatggtttttttggtcccggaacaggctctttactgactcttgcttgtgtaagtttactcggttttaatttagcaaaagcaacggcacatgcaaaagtgttaaattttacttcgaatattgcatcattgctttttttcttacttggagaccaaattttttggaagttgggcttggtcatgatgcttgggcaatttattggtgctaatttaggcgctaaaatggtattaacgaaaggaaaaaccttaattcgtcctatggttgtattaatgtcttttattatgacggttaaaatggcttatgagcaagcttggtttagctggtaaaccgatgaattattggagtaaacatgacagaaaataatgatttacgtttaaccgcacgggtcggatatcaacctcattactcttggtcctatttattgcctaaatattggggtatttggctcggtatttttgctttattaattttagcttttgttccttttcgctggcgagataaattggcaacaaaattgggcagaattatcgctcgtaaagcgaagaaacagagacatcgtgctaatgtcaatttgcgttattgttttccgcattggtcagaaaaacagcgtaatgaagtgattgaaaatatgtttattactgttactcaagtgatgcttgggatcggtgaaattgcattacgttcaaaaaaacacctgaaaaaacgtagtgagtttaaagggttagagcatgttcagcaggcaagagcggtaggaaaaaatattattttaatggtgccacatggttgggcaattgatgcctcggggatcattttacatgcacaaggaatagcgatgacttctatgtataacccacatcaaaaccctcttgtagattggttatggacaatgactcgtcagcggttcggtggaaaaatgcatgctcgtcaaaatggaattaagccttttcttaatcatgtaaagaaaggtgaaatgggctactatttacctgatgaagattatggtgaggaattgagtgtttacgctgatttttttgctacttataaagctactttgccgggattaaataaaatggcaaggttggcaaaagctgttgttattccgatgtttccacgttataacgcacaacgtgggaagtatgaaatagaaatttgtgcacctttagaattaacggaagatccagaacaatcggcgagaatgatgaatcaagcaatcgaatactttgttactccaacaccggagcaatatgtctggattttacgcttattaaaaacccgcaaagataatgaagatatttatcgttagcttgggcaatttgtgctaaactttgtgccgttttgttgaataaacttttctcatagaatcagggaataaaatgaataaattagaattgattaaatcctctattaaatctattccaaatcaccccaaagaaggaattattttccgtgatattaccagccttactgaagtacctgaggcatttcaagcaacaattgacttaattattgagcgatataaaagtaaaggaattactaaagtgatcggtactgagagccggggatttatttttggggcgcctgttgctttggcgttaaatgttccctttattttggtacgcaaaccgggcaaattacctcgtgaaactatcgcacaatcttaccagttggaatatgggcaagatactttagaaatgcatgtaagttctattcaagccggtgataatgtacttgcgattgatgatttattagcaactggtggaactattgaagcgactgtaaaactggtagagcgtttacaaggtcaagttaagcatgccgcctttgttattagtttgccggatctcggtggtgaggttcgtttacgtgaacttggtgtggagccatttactttagtcgaattttcaggtcattaatttcttcaaattaatagagatagataggcaatgagttatcaagtattagcaaggaaatggcgtcctaaaactttttctgaggttgtgggtcaagagcatattttgaccgcactttctaatgggttatgcgaaaatcgcttgcaccatgcctatttgttttctggcactagaggcgttggaaaaacttctattgcacgtttatttgccaaaggtctgaattgtattaggggggttacggcagaaccttgtggtgaatgtgaacattgcaaggctattgaggaaggtcgttttattgatttaattgaaattgatgctgcttcacgaactaaagtagaagacaccagagagttgcttgataacgtgcaatataagcctactcaaggacgctataaagtttatctgatagatgaagtgcatatgctttctcgtcattcttttaatgcgttgttgaagacgctggaagaaccgcctgaatacgtaaaatttttattggcaacaacagatccgcaaaagttaccgattacgatcctctcacgttgcatgcaatttcatctaaaagctttatcagaaaaacaaattgcacagcatttagaatttattttacaacaagaaaatattccttttgaatatcctgctttggaaaaattggcaacagctgcacaaggtagtattcgagacagtttaagtttaactgaccaagctattgctatgggcaacgctaatgtaagtttggatacagtaagtatcatgctgggcttattggatgacaatcagcctattgatattttatatgcgttacagcaaggcaatggtgaaatgttaatgaaggcaattcaagctgtagcggaaaaaggtgctgattgggataagttactggtaactttagcggaaaaattgcatcaaattgccatgctacaacttctgccacagcaaataaatgaagaaaactcgcttggatttttagctaaacatattacgccggaagatgtacagtttttttatcaggttattgttagcgggcgtaaagaattagcatctgcccccaatcatcgtattggtgccgagatgattttgttgcgatccttagcgtttcaccctaagttcattagtccttcttcagcagcaccaatagaacaaagtgcggtgcaaaaatcacaaaatattgttcaaccgcctttagttgagatgcccgttgtttctgttgccgagcaattaccttcgcaaaatctcattcgtaaaccaacgatagcagataaggtcgatactaagttaagtacaacagctttaagtgctttagaagcgttagaacagttgtcacaacctagtgatcattcagatagcgaaaaaaaaaactcgccgatagataatattcatgatatttctttaagagaaaacactgaaaatatctccgcacttcctgttctaaatgttgtgcctaaagatgttgataatgcacttaagacggttactgtcattgataagagtgatcatagaagtgatgaaattcaagaggatagtgctgagaattatcgttgggaatggcgaaatccggaaatggcggttgaggaaaaggctattcgtccttctgaaataaagcaagctattttagaacaagcttctccggagctcatacaacgtataattgctacggcacaagaaagagatgattggactcggatcattgagcaattacctttgagaggtatgacaaaagacatggcgttaaataccgttctattaaatcaatcgggggatcagatcgttttatccttaatgtctgataaacagcatttgttagatcgttgtcataaagaattaaagcaagcattatcggatttctatcaacgtgatattcagttattaatcacacctactgacgataaaaatttagccactcctttatattatcaaaacttagtttatcaagagtttaatgagcaagctaaaaaagcgttacaagaagataacagcctaaaattattagaaaaagaatttgccgctacgctggatttggatagtgttagaccgatttgacatttttactacgatttagatattgtcttgagctttgagcaatgattatataatgatgaaaaaagctaaaaatcgactgcactttttctttatttgcgatccggatcgcataaatgttttttgatgacaaattctcttttcccaaatacaagaaaattgctagattaatcctattgaacaaagtacaatctccgcctctttttgatcatcaatgaatgccataaggtgtaataacggggcaataaataataaatgtcggacaaaattaatttaatgaatttaactcgtcagcaaatgcgagcattttttcaggagttaggtgaaaaaccttttcgagcagatcagttagttaaatggatttatcattttggtgaagataatttcgatcatatgactaacattaataaaaaattacgtgaaaaattaaaaactgttgctgaaattaaagctccggaaattgcagttgagcaacgttcagctgacggtacgatcaaatgggcaatgcaagtaggagatcagcaggtagaaaccgtttatattcccgaaacggatcgtgctacgttatgtgtatcttcacaagtagggtgtgcattagcttgtactttttgttcaacggctcaacaaggttttaaccgcaatttaactgtatctgaaattattggacaggtttggcgagcttcaaaaattatcggtaatttcggtgttactggtgttcgtcctattacaaatgtggtcatgatgggaatgggagagccattattgaatgtggctaacgttgtaccagcaatggaaattatgttggacgattttgcttatggtttatctaagcgtcgagtgactttatccacttccggtgttgttccggcactagacaaactgagtgaaatgattgatgtggcattggctatttctttgcatgcaccgaatgatgaattgcgtaatgaaatcgtgcctattaataaaaaatataatattaaaatgttgatggagagtgttaatcgctatttaaatgtttcaaatgcaaatcacggtaaggtaaccattgagtatgttatgttagatcatattaacgatgggactgaacatgcacatcaattagcagaggttttgaaaaatacaccgtgcaaaattaatttaattccttggaacccgtttccggatgcaccttatgctaaaagctcaaatacacgtatagatcgttttcaaaaaactttgatggagtatggttttacagttattttacgcaaaacaagaggtgatgatattgatgcggcatgtggtcaacttgctggtgatgtgatagatagaacaaagcgtacggcacagaaaaaacggtttggaaaagaaatcggcactcatcaaatttattaactatttttaatgtataaggagagaaaactaatgcgatatcggactatatttacttttattatattctctctttttctttctgcttgcgtttctcagcctacaactggtcgctttaataagcaacaagctgcaaaagcacgaattgagttaggtttaggttatttaaaattacgcaatttttctcaagcaaaacttaattttgataaagctttattctatcaacctgactattatttggtacattcggcttttgcctatttatatcaattacaaggtgatatttcgcaagcgaaatcctcttatgaaaaagccatcagtttggataagtcgcaaggtgatgtgaaaaataattatggtgcatttttatgtagtcagggcgaatttgctcgtgcttatgagttatttgagcaggcacttattacgcctaattattatcagcaagcggatacctatgcaaatatcataatttgtgcagaggcggaacataatattccacgttatcagaaatttttacagttactgaagaatattgatcccaaaagagcggaggaaataaagaaagtttcttagcttagttagcgtgagttgaaagatcaaaaatggcaagactgtcttcttgccatttttattatattatgattttttgatgtaattagattttacaagctcctcctgcacaagcgtcatcaagatcttcttgcatatcttctgcaccatctctagtgttttgataatacagggtttttaatccatatttgtaggcagttagtaaatcttttaataaaaccttcattggtactttaccatcttcaaaacgttttggatcatagttagtattcgctgaaattgcttggtcaatgaatttttgcatgataccaactaagtgtaggtatccatcattacttggaatatcccacagtaactcatagttttcacctaaattctcataatcaggaacaacttgctttaaaattccatcttttgacgctttaatactaacatgtccacggggaggctcaattccattggttgcattagaaatttgagaagaggtttctgatggcattaatgcagttaatgttgaattacgtaaaccaaattcttgaatttctttacgcaaggcttcccaatcgtaatgtaaaggctcttttgttaagttatcaatatcttttttgtaagtgtcaataggtaagatcccttgtgcataagtggtttcatggaagtattcgcaagcaccgatttcttttgccaaattcattgaagcttttaataagtaatattgaatagcttcgaaagtgcggtgtgttaaatcattcgctgaaccatcggagtaacgaacattattttttgctaaataataagcatagttgataacaccgataccaagagagcgacgagctaatgaactgcgttttgctgcagcaacagggtagtcttgatagtctaatagggcatctaatgctctgactgcaagatcggctaattcttccaactcgtctaaattttcaagagcacctaagttaaatgcagataatgtgcatagtgcaatttcaccgttttcatcatggaaatgttgcaacggtttggttggcaaggcaatttccaagcataaattagattggcgaattggtgcaaccgcaggatcaaatggcgaatgtgtgttgcaatgatccacattttgaatataaatacgaccggttgacgctcgttcttgcattaataaagaaaatagctcaacggctttgacactgcgtttacgaacagcgggatcttgttcatatttgagataaagcgtttcaaatttattttggtcagcaaaaaatgcttcgtataaccctggaacatctgatgggctaaatagagtaatttcaccccctttaattaagcgttgatacatgagcttattgagttgaactccatagtccatatggcgaacacgattgtcttcaacccctcggttattttttaataccaataaactttcaacttctaagtgccaaattggataatagacagttgccgctcctccacgaacaccgccttgtgagcaagattttaccgcagtttggaaatgtttatagaatggaatgcaaccggtatggaatgcttctccattacgaatcggactgcctaaagcacgaatagcaccggcattaactccaatgcctgcacgttgagaaacgtatttcacgatggctgatgctgttgcattgattgagtcaagactatcaccgcactcaattagtacacaagaactgaactgacgagtcggggtacgcacacctgccataattggcgtaggcaaagagattttaaaggttgacgtagcatcatagaagcgatgaatgtagtccagacgagtttcttttggatatcttgaaaagagacttgcagcgactaacaaatataagaattgtgcagactcatagatttcacctgttactctattttgtacaagatattttccttccagttgtttcacagcagcataggagaatgtcatatcacgccagtgatcaaggaaaccatccatttcatcccattcttcacgtgtataatctgttaataacgcctgatcatattttcccatccgcacaagtttttttacatgatcataaagttttggcggctcgaaatgtccataggcttttttacgtaaatggaacactgctaaacgagcagctaaatattgatagtcaggactatctttactgataagatctgcggcggctttaataatagtttcatggatatccgaagtgcgaattccttcataaaattgaatatgcgattttaattcgactaaggaaacagaaacattttccagtccttccgccgcccaagtaatgactctgtggattttatctaaatcaataggttctttgtttccgtcacgttttgtgaccatcaatgctttattcataggatttccgagaggttctgatatggttaaaacacaagatatagttataaatcaaaaatgaactacaagataatgggttggacggaaaaattcaagtaataaatttcatctatgattcttgacagaaaataacttacttataaataagtaaaaaatgaaaaagtaataaaaattattatcaaaaattgtgctgtagatcaaaatttatattttttgatatgaataaaatgatctttattctttgtggcaataaaaaagccgttcaaagaacagctttcaagggttattttcctaaattatcaaagaatttttttacaccatctaaaaaacctgaggatttagggcgttggagcgttttaccttctaaacttttttccaattttcttagtaactctttttgttcttcgtttagtttaattggtgtttcaataacgatctcgcagattaaatcgccagcatagccgcgagaggtaatgccttttcctcttagacgaagcagtttaccggtttgtgtttcagcaggaattttaactttaagacgaccgtctaaagttggaatttctacttcgccacctaatgcagccatagtaaagctgatagggacttcacaataaagattgttaccatcacgttcaaaaatatggtgtttttttacatgaataactacatataaatcaccggcaggtgcaccattttcacccgctgctcctttacctgctaaacgtaattgattacctgtatctacgcccattggaatggtaacggtaagattttgggttttatgaactctaccttcaccgtgacaggtatgacaaggtttctctatttttttgccagtaccgtgacagtgtggacaagtttgttctgtaacaaagaaactttgttggcgacgaacacgacctgcaccatgacaggttggacaagattcaatttttgaacccgcttccgcacctgagccatgacaagttccacagtgaacaagagtgttaatttgaatatcttttttacagccttttaccgcttcttccaaacttatttcaatatcgtagcgtaaatcctcaccacgaacaacacgttgacgagaacgcccgccaccaaaaatatcgccgaacatatcgccgaaaatatcaccaaagtcagctccgctaaagccgccgaaaccgccggcaccaccaccttgttcaaaagcggcatgaccatattggtcatacattgcccttttctctttatcagccaaaacttcgtatgcttcattaatttctttgaatttttcttcgctttctttatcacctttagttcgatccgggtgatatttcatcgcaaggcgtttgtaagcacgtttgatttctttatcatccgctcctttttgaacacctaatatttcataataatctcgttttgccatgtgtaatccggttagttgttgcgttataaacgctgatagtcatacgttgaaagggcgtattactacgcccttgactctgattagtgagatatacagattatttatcttttacttcttcaaattcagcatcaacaacatcctctccacctttcgtactttgagattgttgtgcaccggcatcagcttgtgcttgttgttgacttgcttgaagtagtttttcggaaacttgaattaatgcttgtactttggcatcaatttcagttttatcttcaccttttgccgcagtttcaagttcattgaccgcactttcaattggtgctttgtcttcagctgataatttctctccaacttctgctaattgtttgcgggtactatgtactaagtgatccgcttggttacgagcttgaactaactcttcaaatttacgatccgcttccgcattagcttccgcatcacgaaccatttgttgaatttcttcatcacttaaacctgaagatgctttaatcgtaattttttgttctttaccagtacctttatcttttgctgaaacatggataataccatctgcatcaatatcaaaggttacttcaatttgaggcataccacgtggtgcagggttaataccttcaagattaaattgacctaaagacttattggcagaggcttgtttacgttccccttgaagtacgtgaatagtcaccgcactttgattatcttcagcggttgaaaatacttgcgattttttcgtcggaattgttgtatttttctcaatcaaagttgtcatcacgccgcccattgtttcaataccgagtgataatggtgttacgtctaacaataaaacatctttaacatcaccggctaaaacaccgccttgtacagctgcaccaatagcaaccgcttcatccgggttaacgtctctgcgaggctctttaccaaagaattcagcgactttctgttgtactaacggcatacgggtttgtccgcccaccaaaatgacatcattgatttcggaaacgcttaaacctgcatcggaaagtgcaactttcacaggctccattgaacgtgcaactaaatcttccactaacgcttctaatttcgcacgagtcaatttaatgtttaaatgtttaggtccggtagcatcagcagtgatataaggtaaattgacatcagtttgttgagcggaagaaagctcaatttttgctttttcaccagcttcttttaaacgttgcattgcaagtggatcgttacgtaaatctacgccctgttcttttttgaactcatcaactaggtagttaattacacggttgtcaaagtcttccccccctaggtgagtatctccgtttgttgctaaaacttcaaacgttttttcgccaccgacttcatcgatttcgataatagataagtcaaatgtaccaccacccaagtcataaacggcaattgtttggttgcctttacctttatctaaaccataagcaagagccgccgctgtcggttcgttaataatacgtttgacttcaagaccggcaatacgtccggcatcttttgttgcttggcgttgtgcgtcattaaaataagccggcactgtgattacagcttccgttactgtttcacctaaaaaatcttccgcagtttttttcatttttttcaacacttcagctgaaatttgcggaggtgccattttttcaccttttaccgatacccaagcatcgccgttatcggctttagtgatttcaaaaggcataatagcaacgtcacgttgtacttcttgatcttcaaagcgacgaccaattaaacgtttgatcgcaaataatgtatttttcgggttcgtcacagcctgacgtttcgctggttgtcctactaaggtttcattatcatttgtataagcaataatggatggggttgtgcgttcgccttcagcgttttcaatgacacgtggtttgtcgccgtccattacagccacacaagagtttgttgttcctaagtcaataccgataatttttcccataatatgttttctcctagtatctagtataaattcgttgacagtttcaagattgggataatgattgcaatttcaagtgcatggaatgcaaaattttgaaagtgcggtcattttttgccttgttccgtaaaatgtgattggaaatgaaaaattcaagaggaaaaatgaaattttatgtaaattaagttaaattttgttcaataaattgctgtttttttatttgaatcgcaatttctctccgacgatccagttctactcgaattgctttatgttgaaagccttctgaaataatctgttgcacattaacagctaaagctgcttggtagaggcacaacaaaaatttgtattgtgggcaatcggtatagttcatttcggtttgagtcagactatcagcaaggcaaactaacattaattcttcgaagcgttttggtttacgccagacatctaacttattaaataacgttaagattgttttggtgtgcaatgccaaagcatgatgaatatgagaatgatattggcaagttaattctgccagttcttgaacatagttagggactttaaaacgctgacagacatttctgagataagcaatacttgttattttattatcatgagaataaggggggatattggcggttgagagagcttttcccacatcatgacaaagtgcagcaaaacgtaccgcacttttgtgataatccgttttttcggttaacaatgttgtttgcttaagaatgggcatagcatgcacaaaatcagtcatgtctgagcgatattgtatagagtcggaattaaacacactaatttccggacataaaacttttagggcatctattttttgtaagatagcaaaataaacttgtggatcctgttcatgtagtgctttttctgtttcttgccacactctttccggagaaagttgtctcaactctccattattggctatttttttcattaaggctagcgtatctggtgcaattttaaagcctaattgatgataacgggcggcaaagcgagctactctgagaactcgtaagggatcttctgcaaaagccggcgaaatatgacgtaaaataccttttttcaaatcggcaataccattgtatggatcatgatattgccccgccatatcctgagcaatggcattaatggttaaatcacgacgcatcagatcttgttctaatgtaatattagggttgaaatcacaaataaaaccagtatagccggtacctgatttccgttctgttcgtgcaagtgcatattcttctcttgttttaggatttaagaaaacaggaaagtctttaccaacttgttgataaccctgagagagtaaatcttcagctgttgacccgaccacaagccaatcacgatctttaataggtaagccaagtaattgatctcgaacagcaccgccaacaagataaatttgcatcatatcgttaagaccaacgattttggcgacggcgtttcggaattagtagaggtaaaataagaccaagcaataatcctgcacctaaaacagagccaccgtagataaaccactgaatagcgatttctcgtttacccacatctaacatcgcttctaaatcacgatttttattttttgtaatttccaattccctattaaggagtgagttttgttccagtaatttgttgctttgttcttctgcttgtttggtacggcgttgcatctcgattgttcgttgtttccagtcattgtcaatattattgagctttagagttaactcttggatttgagcttttaattttggattttcttccctgctacttggagtactggttaattcacttgttaaaatccatgcttcacgattacgtttgtcacgaattaaggaatatttatcttttttatccagtacggtaaccgactcgcctgcttgaatagttcccgaaattttaaattgatctcctgcacctcgtcgcataaacgttgtgagattttctttcacgtattttgtttcggcataagcgttggataaggaaaatactaatagaagagcggatactaaaagagaggtaatttttttcataataaatccagaaaataaggtcaacaaaaaagtaataaaaagtgcggtagattttaccgcacttttttttgctgacaagtaatgatttattttatctttgagcgttaatgaaaaatcgcataaataatgtaataaatcacaatagcaaagaaagtacccgcaggtaatgtaacaatccaagaagcaacaatattacgaataacggttaagttaattgctgcaataccacgtgcaaaaccaatacctaaaatagcaccaacaagtgtttgagtcgttgatataggtaatccggttcctgatgctaagacaactgttacagcagtagcaaattgggcagcgaaaccacgacttggcgtgaggtctgtaatgcctgtcccgatcgttgacattactttataacccataacaattaaacctactccaatgccgacagagccaagaggcaggatccaccaagccagggtagtttttcctgcaatctcaccaccatgttctatgatggaaacaacggcggacaaaggacccactgcgttggcaacgtcatttgaaccatgagcaaatgccattgcacaggcagttaatagcattaaaatactaaatactttttcaactgctccaaaggttcctttcgtaacattttgaatgaaacgttggctacgaaaataaaaagaaccaagaatacccgcaataatactaatgataccggatataatcagtgtttctatggtagttaaatgtaatccaatatgttttagccctttcgtcatagttacaatagctaaaataagaacggtcagtcccatataaaaaggtccgtatttttgggcattagctaaaggttttggcgtgtcaaagattaacttttgtgtactaaagaaaatagcgtaagcaataattccggcgagaataggggtgataaaccaacttcccacaatattgcgtacagttccccaatcaaccgcatgtgcaccgacagtaatacaagcaaaaccgacaattgcaccgataattgcatgagttgtagaaaccggccaacccatttttgaggcaattaataaccaaatccccgatgaaaaaagagctgccatcataccgaaaaccaaaatttccggagtatcagtaaactgcattggatctataacgccgcttttaatcgtttctgttacttctcctcctgcgaggtaagctcccgcacattcaaaaaacatcgcaataaaaattgcttgttttgctgtaatagtacctgaacctactgatgtccccatggcatttgctacatcattagcacccacaccaaatgccatcaaaaaaccgaaaacggcggtaataataacaagtatagttccgtattcttgtaaaatttccatagttgatcactcctatgtatttatcgttatgaacgagctaacattaattcaattcgtgaacccacacgttgtgcttgatcagctaaaaccccaatccatgctaaagtttcatataaaaacatcacatcaataggactgtactgattttctatgtttcggagcatcatgcgaagtttgatttgcatatgatctgtatcatcttcaatggcatccaactcatggattaggttattgacgagagtcagttcatgtcctttaaatccggtttccaataacgcatccatttcctcgatcacacgatttgcttgaactgtcgcatctaaactacgataaacatatttcataaaatcctcttgcatttcttgaggaaaggtaaattggcgaccgagcattctcccggctatatctttggcacaattcgctaatttatcttgttgagttgtcaactctaataaatctgtacgatcaattggcataaaaagacctaaagggagcttcaagcgaatttcacgtttcagtgtgtcggcttgacgttcaagttctgagagctcagcacggatctttgtggcattatgccaatctccggcaaaggtactttcaaagaaaggaatgagcagtttacaacattcagttactttatcagaatgacgctgtaatggcgttagaggtgaatgggcaaataatcctagaatattattcattgccatatgaattaaactccttagtggatttgataaaaaattcaggcgcatattaccttatgcgaacagaaaaatatagaaatttcatcgaaaaaaataggtttttagtagataatacaggcacgcatttcttagcaaggaaaggaaaatgaccaaggaaatagagcttaaattgagtgtatcaaatgcctttgctcaatttttaagtcaagaaatgacaagttttcatgtgttaaaacaagagaaggtttttttaggcaatacctattatgatacagcggacagttattttgctcggcacaaaatgggcttgcgtgttcgtcaatataataatgattttactttaaccttgaaaacaaacggtgatgtgctgggtgggttacattctcgccctgaatacaatgtatctcaagaaagtgcggtgccaaatttggcgaaattaacagaaatatatgacttaccgaattggcatgaatttgtcttacagcctattttcagcactgattttgagcgttgtttatggttggtagaatgcgggtatgatgtggaaattgaagtggctttagatcaaggctggattattgcaggagaaaaatccgttcctatttgtgaagtggaatttgaattaaagcagggaaaaacagaggatttgttaaattttgtggcaaatttatctttagaaagtgatgttcgcttaagttcagccagcaaggcacagcgaggttaccaattggcatttaatatacaacctcaagttcaggattggatcgcaaaatggcgtgagtttattgtcttagcaacacatgaaaagatcgcttatttagtaaaatttgaacagcaattaatcgaagaaagtgtgatgctgggaaaagattattttgcacaagaatttttgcgtacagtggagcgaatcggtgcattttttaatctatatcacttttatagtgagaacgtaacgttattggaaaatcaagtaaatcttcaattgacgcaaggcattactcatttggatcagaatttgcttgctgatcttgttgaacgtaatgcttatttattgttgcaaattaaagacattattcggtgtcatagtgaaaataaaaataatgcacttgcgattgaaaaattatttgcattatttcatagcggtcagtatgtcaaacgtatgttagatttaacgtttttaacactctaaggatacagcatggcaaaatcacccaaaacagcctacgtgtgtaatgactgcggtgcggagtttgcccgttggcaaggacagtgttctgcatgtaaagcatggaatacgattagcgaagtgcggttagtttctacagcaaaagtgaaaaatgatcgttttagcggatatgcaggagaaacgaaagccaaaattcaaactttagctgaaatcagtttgcaagaaacgcctcgttttaccagtggttttagagaattagatcgtgtattggggggcggaattgtgccgggtagtgcgattttaatcggtgggcatcccggtgcaggaaaaagtaccctactgttacaagtgatgtgtggacttgctcaaagtatgaccgcactttatatcacgggcgaagaaagccttcaacaagttgctatgcgagctaatcgtttaggattgccaacggatcgtttgcaactcctatctgaaacctcaattgaacaaatttgtcatcttgctgatcaactaaagccgcaaattatcgttattgactctattcaggtaatgcatttatctgatattcaatcttcccccggaagtgtagctcaagtgcgtgaatgtgcagcatttttgacccgttatgctaagacaaggcaagttgccattatcatggtcggtcatgtaacgaaagatggaacgttggcagggccaaaggtattagaacatgcaattgatgcatctttattgttagaaggcgaatccgattcacgctatcgcactttgcgtagtcataagaatcgttttggtgcggtgaatgaattgggtgtttttgcgatgacagagcaaggtttgagagaggttaaaaatccttctgcgatttttttaagtcgtggtgatgaacaaacgtcaggaagttccgtgatggtagtatgggaaggaactcgtcctttattagttgaaattcaagcacttgttgatcattccatgttagccaatccaagacgtgttgcagtaggtttagaacataatcgattagcattgcttctagcggtattacatcgtcatggcggtttacaaatgtccgatcaagatatttttgttaatgttgttggcggggtaaaagtaacggaaaccagtgccgatcttgccttattgctggcattaatttccagctttcgtaatcgacctttgccacaagatttagtcgtgttcggcgaggtaggtttagcgggggaaattcgccctgtaccaagtggacaggaacgtattagtgaagcagcaaagcacggttttaagcgagctattgttccctttgcaaataaaccgaaaagtgcggtcgaaaatatgcaagtttttacagtcaagaaattagcggatgcgttggcgatattagataatttttaacaaaattgctggataaaaacgaataaatatctaaaaaatagtgtaaaattagacaaaaataaatattttatgcggaatttctatataaaaagggatgaataatggaaaagaagattaaatcacttgatagtattgatataaaaattcttaatgaattacaacgcaacggaaaaatttctaatattgatttatccaaaaaagtgggattatcgccgacgccttgtttggagcgggtaaaacgtttagaacgccaaggcattattatggggtatcgtgctttattaaaccctgaattattggattcgcctttgttggttattgtggaaattacattagttcgtggtcgtcccgacgtgtttgaggaatttaatgtggcagtgcaacaattagatgaaattcaggaatgtcacttggtttccggagattttgattatttgttgaaaactcgtgtagcggatatggcagcgtatcgcaaattgctcggcacaactttattacgtttaccgggggtaaatgacacacggacttatgtagtgatggaagaagttaaacaaactaattttttacaattgaaataagatgattaaacgtattaaacaattttttttaccgaaaagggatttagtcgagtttttattaattctcaccgcactttggggcttttatttgatcgttgcttggtttagctatagcccgtttgataattcgtgggcgatatcttcttttcaaacggaaactattaataaagcaggtgcattgggtgcttggatgattgatctgtttttcacgttttttggcgtggtaggtaatatcataccttttgtactatttatcgcacctatttattttttacatactaagcgaactcaagggttaacttggggaagattttttcttcggatattgggttttgtgacattgctggttggtttaatgatcttggctactttaatgttggcaaaaactgaacatcatttatcgggcggtgtattaggtgctattttaatcgttaagttatatccgctattttctaaccaatttcccttaattattattggtagcattgcttctataatcggttttattttctgttcgggggcatctttattttatttaatgatgaattgttacgactggctgacaatgaaagataaagaatctctattggatacacaatcgaatggtgctgattcagttgaacaggaattggaagaaattatcatacaatcgccacctatagaacaaaatatcgccaatgaagatactgaaaaacaaggacttgagttagttaatattagtagttttattaatattcaagggttacctgatgaacaagtggaagaacagcaaaatttagcagctccgatgttgatgaagcaaaatgaagtggttgatattgctcaaacactaggcgatttaaagcaacaagaattgcctattccaagcgtttcattgtcaacagaaaaaaatgaagcgttagctttggaaacagaaaatattgtagaacagaccgcactttctgccgttgaggaagctgacaatcacaatataaatgaacttgccaaacaatttgctgaatttgagcaacaacgtttattgaaaatggaacaacaggcaagagaaatcggagcagaggatgcgttaaaagtgattttagctgaagaagttactgaagacgtgccggcggttataaaagaagttgttgaagaaaaagagctcagtcaaagtgcggttaattataagacttatggcgatagtttgattcaccccgcattacagcagaaagtgactgttcaggaaaaaccgacaacaccattgccaagtttagatttacttgaacgccgaacgatccaaacttataacattacccaagaggaaattttagaaacatctcaacgtattatgcaacagttacgtaattttaatgtaaaagcggaagtgcgtgatgtactcgttggtcctgtggtaacacgttatgaattagaattacagccgggagtaaaagcctcaaaagtgacaagtattgatactgatttagcaagggctttaatgttccgttcaattcgtattgccgaagtgattccgggaaaaccttatattggaattgaaacaccgaatatacatcgtcaaattgtacctttgcgtgatgtattggatacggatgagtttcggcaatcaaattatttattaccaatggcgttaggcaaggatattagcggtaagcctgtgattgtagatttagcgaaaatgccacatttattagttgcaggatctaccggttcgggtaagtctgtcggtgtgaataccatgattttaagtttacttttccgtgttaaaccggaagaggttaaatttattatgattgatcctaaagtagtggaattatctgtctataacggcattcctcatttacttacggaggttgttacggatatgaaaaaagcagctaatgccttgcgttggtgtgttgacgaaatggaacgtcgctaccaattgttatcagccttaagagtacgcaatattgagggatataacgaaaaaattgcagaatacgaagcattaaatatgcctattccaaatccactttggagaccgggtgatacgatggatactttacctcctccattggaaaaattaagttatatcgtacttattgttgatgagtttgcagacttaatgatggttgcgggtaaacaggttgaagaacttattgctcgtctagcacaaaaagcacgagctattggtattcatctgattttggctacacaacgtccatcagtagatgtgattaccggtttaattaaagccaatattccaagtcgtattgcttttactgtagcgagtaaaattgattcaagaactattttggatcaaggtggtgcagaggcattattaggacgtggtgatatgctgtattctgcacaaggatcatctgagttgttacgtgtacatggtgcttttatgagcgatgatgaagttgtacgtgttgctgatgattggcgtgctagaggcaaaccgaattatattgaaggtattttggacagcgtaaatgacgaaagtaacgataatgaaactgactatgacagcaatggtgatctggatgacttatttgatgaagttgtggaatttgtcataaacactggcatcacttcggcttcttcagttcaacgtcgtttccgagttggctttaaccgagcagctcgcatcatggatcaactggaagaacaaggtatcgtttctccgctacaaaatggtaagcgggaagtattatcgaggaaaggggattactaaattaatattgcgatataatttgtgcaaaaaaccaccgcacttaattagtgcggtggttttttctttgggtgtagcaagttagctaaattaccattgataccccacaccaaccgaaccgccgacatcgcccgttgaactgcgagtaccttgcaatcgtagcgttattttaccattatcacttactcgtgaataacctaacgccagtgcattttgtcctttaaatgttccggcagatgccgcaaacatggatttacccggcacagaagacatcggcaacccagccgctgccaacgctcctgcaattcctgcacgtaaatttcggtcagtagtattcaattgtgtccgcagttcattgtctttggtgtccacatagtttttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacttctaagcctttaccgtcttgagacatttccactttgatattaccggcagcggtgcggtcgctgttaaatttattgccattcgcaccttcttcacctttaatcgccaaagtaccgcttaatgctgtgtgaatttccatgtcatcattgcctttaaatttcaagcccgatttcgctaccgcctgcaaatcaccgattgttgctacgttggttaactctgcggaactatcaggtttcactaactctacaactttttcatagcctttgtaattttgttcataggcttcctccgcttttgttaagcctgtttgagcttcttttaaatcatttcttgcttgttcaagtgcttttttnnnnnnnnnnnnnnnnnnnnnnntttcttttagcttagcttctgcttgcgttttatcctcgcccgctggcaacgcatttatcgcctgttctaagctacttaccgctaacgctaaatccgtgaaagtttgtgctttgtccgaaagtgctttagctttctcacccaccgcttttactttttcctcaacagctttggtgagttcagtcgctttttcttgagtcttttgcttctcttcttcggtttgtgcttctaagccaagaccacttgccacattgctaatacctatcggcgtggcggtcggctcggctttgatcacgacttgtttcttctcttcctcagaaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgatttttcctgagccgatttttttaccgtcagtaccttttgtggagaatgyaatagatggwycttgayctttctcaaacgattctannnnnnnnnnnnnnnnnggttttgcccctgctttaatagtgattgatggtgagtcagcaaatggatctgctccacttgctccgcctgtgttattcgccccttgtggggtaagtgcaataccgtctttgtcaatttgtactttcgcccccgttgtgccaacttggaatgtggcattttctgaagttaaagaaagtttggtgacttcttcatttgaaccagtaccatttccgcccgcacttcctttaggtgaagagatagattttatattttnnnnnnnnnnnnnngtcgctatggtaacaacagccgtagtaggtgcggttggtgtaccagtcgttgttgtactcgtggttggtgttgtagttgtgctacttgccgaagcagacgacggagcagctgccggagcaggcgacggtgctggagcagctggtgttggagccggtgcagaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaccactaccattttcaaccttgaacttaaatttatttaacgcttgttcaaggtatcctttggtaatgaggtcattttcaccaactnnnnnnnnnnnnnnnnnnnnnnnnnnnnnnnnnccattctcatacatttgtttttgagaaagcgtaaccttttcaaatatcggtgcatttttaaagccgatttcgattttggcgttgccnnnnnnnnnnnnnnnnnnnnnnnnnnnnnnnnnnnnnnnnnnnnnnnnnnnnnnnnnnnnnnnnnnnnnnnnnnnnnnnggagctagtgtagcagacgaaccagcctgattcatatctaaacgcacaatgctaagggtcgaaccaagatagtgcggtgtgttttgagtgccatttgttaccgcactttgatccgctctgaacatcaagcccttgttaatagccgtaatgctttcattaatagcttctctaaaggttgttggggcttttatttgtccttgctgtgttccttgctgtgttccttgnnnnnnnnnnnnnnnnnnnnnnnnnnnnnnnnnnnnnnnnnnnnnnnnnnnnnnnntatcatgtttctctgcaccaagtacatcaaaacctaatttaccaaaaacgctaatcacttccgcaagctgtccgccgttgatggcatcggttgagccggtttcgactttacctgcggcaacgttggtgataatccgctcgctacccttatcccctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttattaccgatagacactgcccattcggcattggtgattttcgtatccctacccacaccgatggattgtagtgcattttttaactctactccatttcctatagcgatgacagaatcgttacgcttaccattattttttgaaatggtaatattcgaccccaaagcgacaatatcatttccgcctgaaacgttgtttttattaccgatggagattgcccattcggcgttttgtatattacctttatcattatctttagtcgctgaaatcgcaatggagtttttagcacctgtacccactaccgtgccgtgtcctatcgctacgccatattccgatttcacctccgcaccgctacccaatgcgaccgcacctatggctcccatatctgttttagcgcctacaccgattgcgatagatttatcgcctttagctccatcgttgttgtaattgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcccttgttratggtttcaatgcttttctcaatggcttctttgaatgtcgttgcagctggagatgtctcacttccattttcatttttcaacttggtaaatgtggttgctttgaatkkttttgwacykytatccacttcygcacctaatactgtaacgccnantttnccnaatgtttcaatnacgctatacaactgtccgccgttaatcgcatcggttgagttaggcattacactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttcaaacttgctgaacccacattaatatctgcactggtcgcagcggtagttttcccttcccatgtagaatttttacccaacgcaaaggaattatcgccgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggttaaatacgttccatcacccttaatcgtgattttatcgccgagtgcggcgttaatatcgctacctgtatttccagcaaaagttaagcctttttgaacaatcgctttagcgacttcggacaggtcttttacattgacggcgttgttggcaattgtaccgctattgccaccgctagtcgcaccatcagggtttcctgagaggactttttcaataatgccggcatttccgtttccgctacttccaccagcaccatttaaccctaaaccgctcgctaagttagtgagttttttgttatttaaatctaaaccgctgtcactaaaggtatagcttgctttattggtacccactttaatggaggcaccagcattgtctacgacaatgcttgaaccgtctttcgtgctttctaaggtagctttaccgtcctcaagttttaatgctgctttgtcgtttcctttactaatttcagacacgccactaaatttaccatcggctagggtaacctctgaactacctgccttgaaagtaattttgttatcacttccattacttccacccaaagcaattttcgcattctcgccattggcaatagacgcaataccttttaagtttttagacaatttaatttctagggtatctgctttgccatttgtaccgtttttcttcgccacgataatattatcaggtgcggttgtaatttgagttgttgcagttgttcctgatgctgaaattgctgtttctccaactattttcaacgtctcaccgagtttgcgagtaacttctttattgtcatttccttggaacttcaagcctttttccacaagggctttcgccacttcggacaagtcttttacattgatggcgttgttggaaattttgttgccgttgttattacctttatcaggattgccagcaagaacgttggcaataactgtactattatttccggcatttccaccagtaccgctagtatctgtcaatcctaaaccgctcgcaagtgcggtgatttttttattaccaacatggaatccttgtggatcaaaggtatattttgccccatttgaactgataaccacattagtatttcttttgttgcctttaccattttcattaaacttaatttcagtttttactttactgtttccgctaccgccattggcgacctctttactagcaatcgaagtaatattagttaatgcgtcattgacattaaacttaacaactccgctttctgccacttctgcggtggtgtttgtgccatttttaaaattcaaaccatcgcttaatttgacggtataatcacccgaaccattcgccttgtatttaatgacttggtcggtaatttttccctctatactggtttttactgctgtaatctctttctcgtttttatccgctttagtagccgtgtcctcaatttttttcgtgattttctcatctagcccaattttgatcgtatcttcaccctcaacagaggttttaatttgattagcagtgcctttcactttcaaagtacccgtttttaatgrcaaggtyttttcaccaccactgtctgcttggaattttaagttagagctgagattattaactttwtcatcaacatattttttagtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaacctttattaattttatcaatattatcatctatcgcttgtttaaatgttttttgtatagctggtgttgaagcagtggctccgttagaacctattaattgattgaatgttgatttcgtaaatccacctgaatttactgtcgcacccaatacagttgttgctaactcttgtaattgtccaaagttggcagcatctttgtcggctattccttttgctaactgggtaatttttttgytrcctaartccaagccatckctttttaakgttatcgttgaaccgctttttgacgagagtttaagaccatcactgttcgtaaagtcaattttattgccactattgccatttttaccggyaatmgargwaatmcctgttaaagystctttragcgawatkktwacckcaytrccgctagcgtttgtcttgatattgccattatctcctttaatatccagtttgctagttactttaaaggttccgttatccccatttacattaaaactggtagcaacatttttgaatttatcatcaacgtattttttgttgacggcatgcttgtcatctgtagggttaccggtaagttttacagtcttaaattcaggatcgtcttttaagccgatagtaaatgttggttttgaactatcgtttttaaattctgtttttaggtttttacccagatgtgtttytkwaccgccggattgaatatttccagctttgattacaatggttgaacctaaataaaaaggtgtannnnnnnnnnnnnttccatcactaaatttatatccttgatttatagccttaatcgtttcgtccaatgnnnnnnnnnnnnnnnnnnnnnnnnnnnnnnnnnnnnnnnnnntaccaatatattcaacagcggtaaaattatgactattaaattctgttttagcattgttagccgtcaaccctaagatactaccaccaagctgattcagctgattccctgtaatcgcttgatccgagttttgtgcaattttgccgtcttttaaattgccgaattgtattttgttcccaagatctttggygcctattttttcatcgaaaccttttgctccgactaatactttgtcctcggaaattgcctgagaatcttttaacggttcgcctgtttgggtatcgactttgtagaattttttgtcatcagccgattttactagcttcactttcttgccgccttcttcggtgtagtaaacaacaagtccttcttttttaacataatataacgctcttagttgtcctacagtggcggcatcactatccaacgcgcccggtgcgacattcactattctacgcaatccaacatgatttttatttcctttagatgaaccgggaccgccctttgcatcttttgttgtatcccaacccccaacggaaataacccctgccgatgtatccgtttcaattctataactggaaccttccggtacatatccttctaaattggaggcattgtaggcatttttttcatttaaactggctgttgttttatctgtatcagtataaaagtaattcgtcgttgatctatatcctaaggcgactgaattttcggatgatgagcttgaattattccccaatgcgactgagtttttagcattttcattaatcttagaatcattccctagtgccatagaggattctgaaagagaagacgaaccatatcctatggcaattgaattatctttcttaatcccaactccggatcctatcccaattgctctcgcacctatgacggttacccccgttcctattgcaaccgagttttctttatgtacgtttgttcccacacctatggctattgtattggttgcatattttccaacattatttaacgcccctaagacgaccgaattagctccccttacataagaggcactacctatggctatggtattatctccattatttgaaatgtgataacccaaggatattgcatgatctccttgttttttcgttttctttatatcttctgttgtggtgatttctacatgattttctttttcatatgtaaatttattttctttttcaagtttagttatcaagtcgcttattttattctgtccattaaaatgattggcaggaaatccatacttaacaatttcattgtgatctcccactttaagatcattaatatcagtagttacagttttcaaccaaggatcttgattttcagtcacattaccaaggttggtttcttgcataatttgagctctgaatttctcagctgatgtatgcgttaattctgcattcgaagacacattaggtcctatcgctattgaacccattcccactgcttttgctccggaaccaaaggataatgatccttctgcggttgattcagccgcatttcctatggcataagaatttttcgcaaaaacccttgatgagtcacctattgctgttgctccgtcagcacctaaaccgacaaacgcacgaacaccgaccgccgttgctctatcggctaatgcaaatgataacgtccccatagccagtgaagcatttccatatccaactgatcttgaccctattgcgattgcccccactccggctgcataggttggggaatatattctgtgatcttcaccagaatctgacctaatatattttttgtaaaaatcgctctcatttactaaatccttataagtaacattactagatgctctatttccattatatccataaattagttttatagtctcttcaggtagcctatcttcaaatcccccaagtcctgctttaatattatttgctccaaaggtaccttttttcccatttgcaaatatatcatcactacctattgcgatagatgattctccagccgccatgacgtccgcacctaaggctgtcccttgtgctgctgcataaacattatttcctattgccgttgcttgagcactttgagctttacttcctttccctacagctgttccatcttctcctgctactgcagcttcatagcctacggctgttgctccatctcgaagtgcttgagctccgtatcctacagcaaccagtccttctcctgttgctttagttttatctcctgcccctattactacaactttttccaacttggtgacttgtccacttactctatgtagtttttttttccctaacacaatattaccattattattattttctccatattcatggtcccaacttgctatacctacagttcctttactttcattaatagctaaccaagcagcatttgatatagtactcacccctaaaaagcctgctatcataaaagccaacggtaaaaccttaaacgttcgtaaaagcccaccgcactttggtttctccgagctgctcgccacttggcgattgcttgccaactcggaaacggctttacattgacctgttgtaatatcgtatttggttttaaatattttgttcatagaattactcgctttaaaaattatctttgaatgacttgttaaatggttattgatcgaatctgttattgattgtttatttattatctcttactgattatttattaaactttagagagaggggataaccctaaataggcaataccttgctttttaaggcatagcagaaaaaggcgaatgatattttcgcaaaggggtttaaaaggggaaatttgggtatgacgagaagttaaaaaatttttaaaatttattttgcaaggtttataaaaaggcgttagcctaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctcatattgttttcgtctatcaaatggttaagtaataaatttgggcgattttatcccaaatttattagtaagggaatgatttcgtgtattttatttgtattttacacttgttgttgattgtttacgatttgcaaccatgatttccacaacaaccgtgatgttcatggtgttcatgatgatgtccgccacatccacaatgatgaccctcttcatcattatcatgtgtacaacaaccgccctctgtatgaatatgaccatgtgccatttcttccagtgttgcttcacgcgttgcaatgacctctacggaaaaatgcaattcttgaccggcaagcatatggttaccatcaactaccacctcattttcatttacttcagtgataacaacaggtaatggcccaagatccgtatctgcgataaaacgcataccgactaccagctcatcaacgcccacaaaaatatctttgggtacacgttgcaccatgttttcattatattctccgtacccttcttccggttttacacgcacttcgaatttatcaccgacagatttaccttccagtgcattctccagtccgatcacgaggttctgatgtccatgtaaatattctaaaggttgatttgccggtgcttcatcaaccaatacgccgtcttcagtgcgtacttggtaagcgatacttaccacaacatttttttctactttcatttttattcctttatgctgtaaaagtgcggtcattttagccaaaatattggctattgtcattcatcttcatttggatattcgtcaaaaaattctccgtcattaccatattcatcttctgttgcattcggatcttcgaagtaagtaccccatccgtcataaatgccaccgaattttgtgattaatggcaataagtctttttgttgtgcatcaatgatttctgcttttaaattaacttcactaatgatgtcaaagcagaaaatagatttaccttgttcatcttcaaattcttccgcttcagaaacttcatagcctgctttgaaagcatcaacggcgattttttctaacttatcaaaatcgtcatgtgcgatatgatgttcaataatatataaagcatcaggatcactaccgtcattgagtaaatcagtaataatttttctagtttcttcttggagatctacaagtgcagtcatattttttcctttatgtttatttagggagtggggataaattcattgcgttgatataatttaattgtcgccatgcttcatagacggtaaccgcaacagcattggataaattcatgctacggctattttctatcattggaatacgaattttttgtgttgtcggtaagttatctaaaattgacattgggatacctctagtttccggaccgaacataagataatcgcccaactcaaaatttacttggctatgtgcaggtgtaccttttgttgtgagtgcaaaaagacggttaggttgttctgtgtttagaaattcattaaaagttttatgctttttgatttgtgcaaattcatgataatccaaacctgaacggcgtaattttttatcgtcccaagtaaatcctaagggttcgattaaatgtaaacgaaaacccgtattggcacataggcgaataatatttcccgtattttggggaatttccggttcatacagtacgatgtctaacataacaaaatcctcgtttatgcaacatggggaattttactcttttatcaactaatcacaaaattattcctaccgtttccttcaaaaaatacttctaagcaaacagaaagtgcggtctaaatgtgcataaaaaaggcggagaactctccgcctttcatgatggaaaatatattattaagctttaggaccagctgcgatgagtgcttttccttcttcatttgtagcatatttttcaaagtttttcacgaaacgacttgcaaggtcttccgcttttgcttgccattgtgctttatccgcataagtatcacgaggatctaagattgcaggatctacacccggcaatgcttttggaatagctaaatcgaagattggtaatgaacccatttccgcactttcaattgagccgtctaagatagcgtcgataataccacgagtatctttaattgagatgcgtttacctgtaccgttccaacctgtattgactaagtacgcttcagcaccagaatctttcatacgttttaccaacacttctgcgtattgggttgggtgcaaacttaagaatgccgcaccgaaacaggcggagaatgttggcgtcggctcagtaatgccacgctctgtaccggctaattttgcagtgaaaccggataagaagtagtatttagtttgttcaggtgtgagttttgaaaccggaggtaagacaccgaacgcatctgccgttaagaagataacttttgttgcatgtcctgcttttgataccggtttaacaatattgtcaatgtggtaaattggataagatacacgagtattctccgtttttgaaccgtcatcaaagtcaacggaaccatcctcacgaacgacaacattttctaacaacgcatcacgtctgattgcacgataaatatcaggctcgctttctgcggaaagtttgattgtttttgcataacaaccaccttcatagttgaagacaccgtcatcatcccagccatgttcatcatcaccgattaattgacgtttcggatcggttgaaagcgttgttttacctgtaccggataggccgaagaaaatcgccacatcgccatctttgcctacgtttgcagaacagtgcattgaggcgataccttttaatggtaagaagtagttcatcattgagaacatcccttttttcatttcaccgccgtaccaagtaccgccgattaattgaacgccctcagtaatgttaaatgccacaaagttctctgaatttaatccttgctctttccaattcgggttagttactttagaaccgttcataaccgtaaagtccggtttgaaattttgcaattcttcatcagacggacgaataaacatattttttacaaaatgtgcctgccatgcgacttcagtaacaatacgcactgctaaacgtgtatcagggtttgctccgcaaaaagcgtcgataacaaacaaacgcttgccggaaagctgtttggtgaccaaccctttcaaactttgccaagtttcttggttcatcggcttattgtcgtttttcgccgcatcgctcgtccaccatactgtattttttgttttttcatctaaaacaatgtacttatcttttggcgaacgaccggtaaaaattcccgtatctaccgcaaccgcacctgaagtggtaacaacacctttctcgaagcccgctaaacccggtttggtttcttcttcaaaaagttgttcataactcggattatggacaatctcttttacatcatagatgcctaattcacctaattcatttattactttgtttaagtcagtcataaaacacctcatagttaaaagttaattttaaaagttaatcatttagtggtagatattatagtgaaaataagaaataaaaaatgttatcttgatctcaaaattgaaaaataaatgaaatgaatgttgagaattataaaaagcgatggttgaaccatcgctttgaattaagattaatatgattatggataaacaggaagacgtttgcaaattgctaatactttttctttagtatcagcaatgacttgttcatggttatctttattcatactgtctaaaatatcgcacatccaaccggcaagttccgccacatcttcttcgttgaagcctcgacgagttacagcaggtgttcccacacgaatacctgaggtaacgaacggtttttgcggatcattaggaaccgcatttttattaacagtaatattggcacgacttaacgccgcatcagccgctttaccggttaagccatgattgactaaatcaactaagaataaatggttttctgtaccgttagagacaacgttgtaaccacgttgtttaaaaacttttaccatagcttttgcattttttactacttgtgcttgataagttttgaactcaggttccaaagcttctttaaaacaaacggctttcgctgcaataacatgaactaacggtccgccttgtcctgccggaaataccgcactatttaattttttgtaaagttcttcattgccgttggcaagaattaaccctccacgaggccccgctaaggttttgtgtgttgtggtggtaactacatgagcatgtggcattgggcttggatatacaccggcggcaataagccctgcaacatgtgccatatcaacaaataaatatgcacctacttcatcggcaatttcacgcatttttgcccagtcaacgatttgagaataggcagaaaatccgccgacgatcatttttggtttcacttcatgagcctgtttacgcaacgcatcatagtcaatcagtccttcggatgtaataccgtattgctccgctttataaattttaccggagaaactgaccgaggcaccgtgagttaaatgtcccccatgagcaaggctcattcctaaaatggtgtcccccggatttaataatgccatataaaccgccgcatttgcttgtgagccggagtgcggttgaacgttagcataatctgcaccgaacaactcttttgcccgatcaatcgctaattgttcaacaatatctgcatattcacaaccgccataataacgtttacccggatagccttctgcatatttattggtgaattgacaaccttgtgcttccattactcgtgggctggcatagttttctgaggcaattagctcaatatgctcttcttgacgaagattttcatcttgaatggcttgccataaaaccggatcgtaatcggcaatattcatacttctttttaacattatgttttcctctttgctcacttatgaaatggtaacagtttacctgttttaacttaaaaatttaattaaaaattaattcctatttttcatcggtgtaatgaaaaaatttcattcataaataccgataagattgaccgcacttttattgattttctcttgctacggcacgataaccaatatcttgccgataaaaacgtccgctccattggatttgtttcgccaattttaatgcttgctgttgtgcggcaaaaacattttcacccatcgctgttacacaaagcacacgccctccattcgtcaataatcgctctcctttttgctcaactccggctaaaaaaactttttgattttcacccgcacttattggcaagccttgaatttcatcgcctttgcgatagttattcggatagccttctgcggctaaaacaataccaagtgccgcttgctcagaccattcagatttcacttgatccaatttaccctcgcaggcatttaaacaaagctcaaccaaatcagaccgcatacgcatcataatcggttgggtttcagggtcgccaaaacgacagttaaattcaattactttaggctgtccgtgtttatcaatcattaaaccggcatataaaaaacctgtataaatattgccttctttcgccatgccattcacggtaggataaatgatctgttgcataattcgcgtatgaatttccggtgtcactacaggtgccggagaatacgctcccattccccctgtattcggaccagtatcattttcgccaacacgtttatgatcttgtgaagtcgccatcggctctacatttttaccgtctaccataacaataaaactggcttcttcaccctctaaaaattcctcaatcactactttgctaccagctttgccaaaagcattaccggaaagcatatcttgaatagctttttccgcctcagccaacgtcattgcaacaatcacacctttgcctgtagccaaaccgtctgctttaacaacaatcggtgcatctttttcacgcacataagcaatcgctttttctgcatcagtaaaactgcggtattcagcagtaggaatatgatggcgagcaagaaaatctttcgtaaatgcctttgagccttctaattgagccgccgcttgagttggaccaaagatttttaaccctgatgctcgaaaagcatcgaccacaccaagcactaaaggtgcttcaggtcccacgatagtcaagccaatttgattttcttgtgcaaagttgaccagtgcatcaatatcagtagcggaaatagctacattttccaccgcacattttccgtctgtttccatagctgtccccgcattgccgggtgcaacaaatattttgcttgctaaaggtgattgtgcgactttccacaccaaagcatgttcacgtccaccatttccgataattaaaatattcattgtttttccttccttaactgttttttaggaataaagaaagcgggaggcgtattttccttaatatttaaataccctgaatctcccgttagaattgaatgattaattgtaccatccctacaatcagatatatccatatcataactcatgatgttaattaaaaatgtagccagttgctgatgaaacatttttttacaagatgaaaaatggttatgaaaaatatcttgtaaaaacttattttcagaataaataaaaataggcactaaataattagcttcatttaatgttccttgattatatacttcattagaaacaaactgtccgtgatcggaagtataaattaaaacccaatcttcaggttttaaagatgttttaagataattaaacactttttcaattaatttatccgtattatatatagtactatcatatttatctaaaggggtgttctctttgaaaactttttcttgctcagataaataataagcatagggtgtatgagatcctctttggtgtaaaacaacgaagtgcttcttacccccccccacctcacttaaatctatattttccagtaatggaaataagttatgatcatgcattccttcagaagatttatacccaaggctattaggaaaacgcaaatcatcgacccacgttttacccataagactcataatcatcatttgattttcaggttgtgaagaatagaaatatgtttcatatccctgctctttagctaagcggaataagttagttcttccgctaacaatttgttctaacccatttggttttggaatggcattaaacaatgatgggagagaaatagcagtccttgagcctgctgaatatgcaggttttaataatgtttcagtaggaaaattttttgataaagatgttaagaatggggtggtttctctctcataccccaatgcacttacattatttgcacttacactttctcccataatccaaataatattaggtatttggaatgagaatttaggtttcggcttcggcttatctttgtaataaaccgatacgttgctcaaattaaataaatcatagggtaaagttctacctataaaatatccaaaagaaaaataatttgctttaattcttgagtagcccggattggaagtaattcccagttcttgatcagaataaaaactacgaataaaaatataagccatacttaataggaataaaatatctgcaattaaatatgttttttttctaaatcttgaaatagaagaaaaaataagaatatcaaaaacaccccaaattatccctccggatattttatccaacatatgaataccggcatttgtaacttcccaatattctttaaacattaataaataatttgtaccattaatccagctttgatagacctcataatgaacattattaactaacgtactacaagaaaaaaataacaaaataataaaacgagttatcttatattttgagaaataaaataatgaaattaaaataaatattattagaaaactctcactaattttgtataaactatttattccaaaaaaatagcgataaagtatttcactaattaataaaacagcagaataactcaacaaaacaatgatatttttcatgaaaatccttatttattaatgtctaaaatgacgcattttagtgagtaccattaccatattatgctcattggcggcatcgataacttcttgatcacgcattgaaccgcccggatggattacgcattcaataccaacttttgcggctgcatcaatgccatcacggaacggaaagaaagcatccgatgccattacacagccttttacttccaaaccttcatcttttgctttgatccctgcaattttcgctgaataaacacggctcatttgtccggcaccaatccctacagtttgattatttttagcgtatacaatagcgttggatttcacaaattttgccactttccaacagaataaaagatcttccaactcttgtttggtcggttgacgtttactgactacttcaagatctgctaaatccaccatagataaatcagcctcttgtaccaacaaaccgccattgacacgtttaaaatccaagcgttgtattgcactttcccaattgccacacatcaataagcgaacatttttcttacttttcacaatttcttgggcggcggaactgacggtcggtgcaatgatcacttcaacgaattgccgctcaataatggcttttgccgtgtcttcatctaactcacgattaaatgcaataattccaccgaaagctgaggttggatccgtttggtaagctcgattataggcttcgagaatatccttgcccagtgctacaccgcaagggttagcatgcttaacaataacacaagccggctcggaaaaagatttcacacattcaagtgcggcatcagtgtcggcaatattattataagaaagtgctttaccttgtaactgtttagcggttgagacacttgcttcttttacgtcttgttctacatagaatgctgctttttgatgaccgttttcaccataacgcatagattgtttacgtataaaattaagatttaaagttcgtggaaattgaccgcacttcgcttcagcttcttcttcagctctgaaataaggttttaccatttgtccgaaataattggcgatcatgctgtcatattgtgcggtatgttcaaacgctttaatggctaaatcaaatcttgtctctaatgttaaactatttcgattttgatccatttcagcaagaattgcattaaaatcgccattattgactacaatagccacatgttgatgattttttgcggcagaacgtaccattgtcggaccgccaatatcaatgttttctactgcatcttcaagtgtgcaatcaggttttgctacagttgccgcaaaaggatataagttcactacaaccatatcaatagcatcaatttgatgttgcatcataacttcatcatctataccacggcgacctaaaatgcccccatgaattttaggatgcaaggtttttacacgtccctccatcatttcaggaaaacctgtataatcagatacttccgtaacaggaaccccgttttcagcgagtaattttgccgtcccccctgttgataatagttttacacctcgtttaactaaaccttgtgcaaattcaacaattcctgatttatctgaaacgctgagtaatgcttgacgaataggatgatttaattgcattgaatatttcctttattttaaccgacaaaaaacgcaggcattataacgcaaacgtttgctcttgtgtaaataaaaaagcctataattaagtacagaatgaatacatgtagcggtaaaattatttttccactgctttatatacgcactaaaataccctgacattttttgcaaaaatataccgcacttttttgttgaatgttgtgatgacgacgtgcggacaattgatgggtttgacattgacattgataagtaaacgttttgcctcttacattcgttacatcaaactgatgacacgtatccgccggaagctgaaaaatcttgttcatcacatgttgccattctgagccgtgaggttttacacgcccgaattgttgatacacaattaaatgtgccaactcatgaggaactacttgctgaataaattgttgcggattttccagcaataaagtgcggtttaattttatgctgttttgttgtaaataggcgacccctgctttcattcctcgcacatcataactgactgtcggcatcgcaaaattacattgaaaatattgttcagccagtattaagcaatctcttaaacgtctttggatttgcatttttatatgacgaaactcagctaaattttgttcagttttaggcataaagtgcggtcaattttgggtaagatttataaacaaaaggcgaactgttgagttcgcctcatatgagaaattaatcgttattttaaacttgcggcagcacgtaattcttctgcacgatccactttttcccaagggaattgttctcgtccaaaatgtccataagcggcggtttgacgataaataggttggattaaatccagcattttaattaagccataaggacgtaaatcaaaaaattcacgaatcagagcaaccagtaattcattggcaacttttcctgtaccaaaagtttccaccataatcgacgttggttccgctacaccgatagcataagaaagttgaatttcacaccgatcagccagccccgcagcaacaatatttttggcaacataacgagcggcataagctgccgaacgatccacttttgacggatctttacctgaaaatgcaccaccgccgtgtcttgccgctccaccgtaagtatctacaataattttacgtccagttaaaccgcaatctcccattggaccgccaataacaaaacgaccggttgggttgataaaatatttcgtctcttttgataaccattctgccggtaaaatcggtttaataatttcttccattaccccttcgtgaacagttttttgatcaacattatcagaatgctgagtggaaaggacaactgcgtcaattccgacgattctattatcttcgtatttcaacgtaacctgacttttggcatcgggacgcaaccaatctaatataccttttttacgcacttgtgcttgacgttccattaagcggtgagcataagtaatagcggcaggcattaaaacgtcggtttcattcgttgcatagccaaacataatcccttgatcaccggcaccttgatctaatggactttcacgatccactccctgattaatatcagaagattgtttaccaatggcatttaataccgcacatgaatgcccgtcaaagcctatgtccgaatgtttatagccaatatcgcaaattacttgacgtgttaagttctcaatatccacccaagcagaagttgtaatttcaccgccgactagagccatacctgtttttacataggtttcacaagctactcgagcttttggatcttgtctcaaaatctcatcaagtactgcatcggaaatttgatcggcaattttgtccggatgtccttccgatacagattcggaggtaaataaataagatgacatagattttccttaatggtagaaatttttattaatattttttttagatgttttaacgtctagacggctatattacgcttttttaattaaaaggcaagtcttaatttaggttgtataaagggacagattgtgaaacaatctgcaaattattcggcattgtgcggacaacaatattttcatttcaataatttaacaattctcaaaaaagaaaatatattggttagcacctacttcatgtcaaggttattaaaaattaacaattaattaaggtgaaggagagtgatcgatttcgatggatatcgccctaatgtaggtatcgtgatctgcaatgcagaaaggcaggtgctttgggcgaaaagatatggacaaaactcttggcagtttccacaaggtggcataaatgacaatgaaactgctgagcaggcgatgtatcgtgaattatatgaagaagccggtttaacaccgaaagatgtcgagattttatatgtttcaaaacactggctacgctataaattaccaaaacgcttacttcgtcatgataaccgaccaatttgtatcggacaaaaacaacgttggtttttattgcaattggtttctgatgaaaaaagaatcaatatgcagcacacaaaatcaccggaatttgatggttggcgttgggtcagtttttggtatccggtgaggcaagttgtcacatttaaaaaagatgtttaccgtaaggtaatgaaagagtttgcattgtttttatttgatacaaatttaaaatctcgactatctgtaccggaagaaaaaaaaatgttttcatcggttaagaaaaaacttattcacaaaaaaaatcataaatattcttcaaatcagtgagggggataaaatgttaaccttttttctcatttgtctaggtgtaggaacctttgcagggtttcttgctggattattcggtattggcggaggactcattattgttcctacgcttgtgtatttacttccgatggttggtgtgccggatcatctgctcatgtcaaccgcacttggtacgtctttcgctacaattgtcatcaccagtttttcttcagcacagcgtcattacaaacttggtaatgtagtttgggatgcagttaaaattctcattccaactctgatgttatcaacgtttgtttttaccggtattgtcagtcaattagataagagtttatccagtaaactctttgcagttttagtcgcttatatggcaataagaatggttatttccactaaaattcaaatcaaaaatactaaaaaactcactcctttatcgtcagttattggcggcgttttaattggtattgtgtccagcattgcaggcattggcggtggcggatttatcgtaccgtttttaaattctcggggtgtagatataaagaaagctattggatcttccgcagtttgcggcatgctattagggctatcgggggcactcagttttatgcgtagtggttggggcgttactgaaatgccggaatattcgcttggttatgtctatttacctgctgttttaggcattaccatcacctcattttttacgtcaaaaataggtgcaactacgacatccaaactgcctgtacctacattaaaacgctatttcgcaataatgctttgtgtgattgcacttaatatgctttttaaataaggaaatttaatgaatacattttttcaaatgccctatattgatcctgtcatgtttagcttaggacccgtcagtttacattggtatggtgttatgtatttgctcggttttggttttgcttattggctcggaatggctcgggcgaaaaaatcaaatggagtatggacatcagaacaattggaacaattattatacaacggatttcttggcgttattttaggcggaagaatcggtgatgtgttcttttacaacgttgataagttttttgctgatccactctacctatttcgtatttgggaaggtggaatgtctttccacggtggattaatcggcgtcattctcgcaatgatttggacatctcgtcgccaacgtcgctgtttttggcagaccgcagattttgtcgctcctttaattcctttcggtttaggcatgggaagaattggtaactttattaacagcgaattatggggaagagtaacagatgtaccttgggcaatcattccttacgcttcaaccacacctcgacatccatctcaactctatgaagcctttttagaaggtttcattttattaatcatcttaaatctctatattcgcaaaccacgcccaaccggttccgtagcaggattgtttttaatcggctatggtatcttccgtttcctagtggaatatgtacgagaaattgatcacaacgtaaataccattgatgaccttctcacacgagggcaattactctgtttaccaatgatattcggtggacttgccgtgatgatttggtcttattctcgttcaaaggcaaataaaagtgcggttaaaaaagggtaaatttttatgcgtcaatatttaaatttatgtcaacgtattattgatcaaggtcattgggtcgaaaacgaacgcacggaaaaacgttgcttaacggttattaacgccgatctcacctatgatgttgcaaacaaccaatttcctttaattacgactagaaaaagttactggaaagcggctatcgctgaatttttaggctatattcgaggctatgacaatgctgctgattttcgtaaattaggcactaaaacatgggacgcaaatgccaatgaaaatcaagcatggctcaataatccggtacgtaaaggtacagacgatatgggaagagtatatggcgtacaaggtcgtcgttggcggaaaccgaacggagaaactgtcgatcagctacgtaaaatcgtcaataacctgagcaaaggaattgatgatcgaggagagattttaacctttttcaatcccggtgaaattgatctgggttgcttacgtccttgcatgcacactcacacattttctttactgggcgatacactttatttaaccagttatcaacgttcatgtgatgttccgctgggactcaatttcaatcaaattcaagtattcacattcttagcattaatggcacaaattaccggcaaaaaagcgggacaagcctatcataaaattatcaatgcacatatttacgaagatcagtttgaattaatgcgtgatgtacagcttaaaagagagccttttccgcttcctcgattagaaattaatcctgatattaaaaccttggaagatttagaaacttgggtaacaatggacgacttcaaagtgattggctatcaatgccatgaggcgattaaataccccttctcagtttaaaaaataggaaaaacctcaacagtgcggtctgattttgatgaaaaaatgatgcgttatgccttatctctagcggataaggcggaggcattgggagaaattcctgtcggggcggttttagtggataaacaaggcgatattcttgcagaaggatggaacctatccattattcacaacgatcctaccgcacatgcagagattattgcattacgccaagccggacaaaaattacaaaattatcgtttacttgacacaaccctctatgtcacgctggagccttgtacgatgtgtgccggtgccattttacacagccgaatcgggcgtttagtgttcggtgcttatgactataaaacaggtgcggtcggctcacgctttcatttttttaatgattacaaaatgaaccatatgctggaaattacagggggcgtgttgcaagaagaatgtagccaaaaaataagtacattttttcaaaaacgtagaaaacaaaaaaagcatttaaagcccaactttaaacctttcctttaattcttgtaactgatctctaattgcagccgctttttcaaattctaaatcttgggcaaatttatacatctgttgctcaagttttttcacttgttgttgatagtccttaggcgaatttatcttttgataaagtgcggacgattccgccacagttttagcacgagcctttgttttacttttcgttatagcaccttgcccaatatccagtaattcgcccacttttttatttaaagcctgtggcacaacgcctttttccgcattgtatttcatttgtttttctcgccgacgatgagtttcatcaatcgctttttgcatagatttcgttatgctgtctgcgtataaaatcgcttttccgtttaaatttcgtgccgcacgaccgatagtctgaataagagaacgttcagaacgaagaaacccctctttatcggcatctaaaatcgcaactaaggaaacttccggaatatccaaaccctctcgcagtaagttaatcccaactaatacatcaaattcacctaaacgcaaatcacgaatgatttcaacacgttcaacggtatcaatatctgaatgtaaatagcgaacccgaataccatgttcttccaaataatccgtgagatcttccgccatacgtttggttaacgtggtgaccaaaactcgctcattttgctccgctcttttccttgcttccgataacaaatcatcaacttgaatcgctacaggacgtatctccacttccggatcgagtaaaccggtaggtctcacaacctgatcaataatttcatcgcccgatttttccaattcataaggccccggtgttgccgaaacgtagatagtctgcggtgctaaacgctcaaattcttcaaaacgtaatgggcgattatccaacgccgaaggcaaacgaaaaccgtattccacaagcgtttctttgcgtgaacggtcgccacgatacataccgcctatttgcggaacagtgacatggctttcatcaataattaacaaaccgtcacttggaatataatcaaataacgttggtggcggctccccctcatctcgccctgataaataacgtgagtaattttcaatccccgaacaatatcccaactcattcatcatctcaatatcaaattgagttcgctgagttaatcgttgttcctctacaaggcgattatttgccaacaaatattcacgacgtgcctgaagttccaacttaattttttcaatcgcctctaaaatacgttctcgaggtgtaacataatgcgttttaggataaatagtatagcgaggtatcgcaccaaaattcgctccagtcagtggatcaaataaactcaaacgctcaatttcatcatcaaataactcaatacgtactgcccgatcatcagattcagccggaaaaatatcaataatttctccccgcactctaaatgtccctcgttgaaaaacctgatcattgcgggtgtattgtaattctgccaatttcgccaaaatttggcgttgatcaacaatcgcaccatgttgcaaatgcaacatcattttcaaatagctatccggatcgcctaaaccgtaaatcgcagaaacagaagcgactacaatcgtatctcgtcgctcaagaaaagatttagtcgcagacaaacgcatttgctcaatttgatcattaatcgaagcatctttttcaataaacgtatcactactcggcacataagcttccggctgataataatcataataagacacaaaatattccaccgcattttccggaaaaaaagccttcatttccgcataaagttgagcagccaaagttttattaggagccaacaccatagcaggacgattcaatttcgcaatgacattggcaatcgtaaaggttttacctgatccggtaacgccaagcaatgtttgatgtgctaacccatcattcagattctccgctaattttgcaatagcttgtggctgatcaccggcgggttgaaagtcggaatgtaaaataaaaggcttactgttaattttgctcatagcaacaaaaatactaaaaaagggcggtgcattctagcataaaaaaacgtttctttactgacaaaaataggataagataacccgaatttttacttgacaaataaaatagaacagaaaaaatgacagtctacagtctacagtctacagtctacagtctacagtctacagtctacagtctacagtctacagtctagtatgttgcctaaaatcaacctttcaagttaaatttgagaggttggacatgttcaaacaatatcttaaaaatcacctatttcaacctcaacctttcggcgaagataccattcgcctttttttgttgtgtcttaaaaagcaaggcatttcctgtttaggtttataaccaactcctaaaaagtttactaaacaatcaatcaaaatcaacgcaagaaataattaatttaaaaaatccatttttaaagagaatagagatatgaacaaaatattcaaaaccaaatacgatattaccacaggtcaatgtaaagccgtttctgagttagccagcaatcgccaaatagcgagcagttcggagagtaagccgaagtgcggtgggttttggggtaattttttaagagcgtttaaggtccttccgttggcgttgttgcttgcgggatttttctctaattttgcttatgctgctaatgtttggttagaaaataaaaaagacttatcacaaaatggacagttaaatgaggggactggtgtttggtttgacggttcaaatatggaaaacccgagcaaaactgagtcaaccatcttatcgagtggagaaaattcaacaggagaatttgctcaaaaagctggttttaaaaataaaagttttaataggacagtcgtaataggctcacgtgccgttggaggcggagatgctactacggtaataggttatagagcaattgcaggagcaaatttatctgaaagacataaattatcttcgcaaggtacatcgataggttacagaacatttgctagaggggaaggggctactgcaatgggaaatgattccactgcatggggagataacgctattgccattggttctgataatgcgaaagcaacaagcacttcacaaatagacagcagagcagaacgtcctttaagtagagatgtttggaatcttgtacacagcaaaagaagtgattttctttatacagatgaatacgcaacaacatatcaaaagttggatacttatgacaagtatttaggagtaaaagatgattctgaagcatataagctaaaaagatcccacacatgggcaaggggacataactctatcgccattggggcaagaagtatagcctacggcgataacagtacggctatggggacgttagcgacagccatcggtaactactcgacctcgttgggggcattttctatggcgtttggagatcgttcgattgccatagggaatgaaagctatgtgtatgccggcggaagtgtcggggttggtaatgaggtgcaggcaatcagtgatggtgcgatggtttatggcttggaatcttatgcgggcggtgatggttccattgccatagggaaacgtgctttagcaaacgtagaaatgggggatatgtttaagaatgctgttgaaaatggcaagaatttatacgaagcagagagtactttttcaaagttaggcgaattagataatagcgttcaagattactttaaaccaagcactgagtatcagcagggttccggggaacacaaagccaaacgaaataaaaactcaggcaagcaagatgctacaggcggtttagccattggttactatgtatccgcactaggggaaaattcattggcgttaggtcgtcaagcctatgcgaaaggcgatcgctccatggctatcggtccttatgcstatggtgctraggaaaaaacwgcygcactrggttatrgatccaaggctataggaraacaatcaatggcgttaggatcgctrtctcgtgcagaggggmaaaacagtatcgctattggggtcaatagtgcggtraaaaatgaawctarywstamwaaaagaaacggtswaaacacgatagccatcggtaaygaaaccgaagcgacsatggataactcmgttgcsttgggytataaatccacsacraaatatttytataataagagtgataacagtaccgccacgttaaacggagatgaagccattagtttgccatcctatgcaccggaagggacaagctataagttacaaaccgataatgcggcgggtatcgtgtccgtcggttggaaaaaaagcgatagtgaacttggtctaagaagaattgtcggggtcgccgcaggagcattggactccgacgtcgcaaccgtgggtcagttaaaagccttgtattacgtcaaaaaagaaggggtagtcacttactataccaaagaacctgacgggaaaatcaccaaactcaccaaagacggcagtaagttttatagagtcaacaccaaagacggcacgccttataaagagttgcaggaagttgatgcaaaagatgttttcgtcggtccaaaaggggcgaatgaagaaacaagagaagaaatgaaagacggcaaaaaatattcccttggtaatatgggtaatctaattaaatttgccaatattttagatggagagatttctgcgacttccgatcaggcggtaacgggtggtcagcttaacgatcttaacggcaaattaggattgacactaaatagcaaaaaaacaggctttgagaaagtccaatttgatgcagtagaagtagctgatgaaaacgttaaaaaaggaaaaatagaaaatttcaaagaagccttgactgactctatcgctgcaattaatagaggttataaatttattgatgacaactctcaaaattcagacaaagatacacctttctatctcggatcaacaataaaaattgtggcaggaaatatttctgcacaaccgaatagcaaacctcaagaaacatatttaggtaaaaacctcaaaacaaaatttgaaaaagagccaagcaacaattcaatcgctaaatttacgattggcttaaaagacgatccgacatttacaaaggtatccttagaggcagaacaaacatataattctgacccatcaaaaaatacagtcaaagatacaaaagaacttatcactaaaggytayttrgacggtgcattarmaaaygtygcctcaagtttcacggttaagggagatgatamaagtaaatcattkarcattgataaaartmatacgactttaactattaaaggcggaaacaatattaccacagcrgttgatactamccaaaaagccttaaccatatcrytkaawgagrstttaacagryattacctcrattascggtaaaaatggtagcggaagtaacrgaagtgcggtarcaaaaattgartttratagcactgcaagcggtagcaacgcttcaaccccgaaygtcaaaatcaccrcwggyggtrgcacatttayctttagtgaaaacggcttaaatttgggtagcaaaaaaatcactggtttagcagagggttcagacgacaccgatgccgttacctttaaacaactaaaagattcaaaattgcactttttatcggttaaagccccgacaagcccagagtcaaaaagcaattacaataatgacggtgcaaaagctgaaggggcgattgcgattggtgtggatgcgaaaactgataaagcaaatgcaattgttatagggaatagtgttactgttgatcaagaaaaatcaatagcgttagggaatgatattaatattaaacaaagtaaagcaggatattcaactgttgcaataggtaacaaaataacaatgaatgaatctggtggttctattgttttatctgctatgaatcaatggaatggtcctgatgatggtataacactaaacaatgttggttggggtgttatattaggaaataaaaccaaaatagagggcggaaacgatattgttgctttaggtaacaatatgaatgtgactaggagtaatggaagcaaacacgatctaaatagcaatttgatcatcttaggtaatggtgcaaaagcccatgatgcaaaagaaagtgtggtgattggtaatgtcgcagacgtgaaagcccaaagtgcggtagcgattggtaaaggagcgactattgaagccaatgccacaggtgcggtagcgattggggaaagtgcgactgtatccactaacgctggtgattccattgcgttggggaaaaattctaaggcggaaatgaaaaaggccgcaccgactggatttacggttaatgcaggggcaaatgacctaaaaattacttggtccagtgcaggggctggtggaagcaaatctgtggtgagtgtcggcgataaaggtagtgaacgcataatcaccaacgttgctgcaggtaaagtcgatacagattcaaccgaagcggtgaatggcggacaattaaaaagcgttatcgatgtctttgctaatttgggggtaactgtactcggggcggagaaaaacgatactggcgatggctttaagaaatccaagtttgatgyggtgaagactgscracacagtaaattctcaarctcaagyaaaatctgagaaaycctttaaaacagccattgaagataatattacagccatcaacaaaggcttgaartttgctggcgataacggcggcgaagcgaagcaactctatctcggttcaaccttaacgattaarggrgcgamaggysmtgcttcaaaaccaacaacaagtgcggggcaaaacggtgcaggtactcatcaaaatatctttaccacagcgaaaaatacaggcattttggaaattgctttgaatgaagagttgaaaggtattaaatccgttgctaatggagacgatgtaaaaattgaattaaaaactactggaactggtggaaatggaactacaaaatctatcgttttcacagctggcgatacaaacaataaagtaacgctaactggcaataaattcagtggcgtgtctgaaattagcagtaaagacagtaaatctaaattaacacttggtgctgataacgcaactgtagaattagaacatggcaaatcaaaacttgaactaaaagatactgaagcaacaatcacagcaggaactgatgctggaagtattaaaattaacaataacggtgatacgaaaattgagttaagtcctgaaagtggctctacagttaccttggcaaaagacagcacgaatggcgtaaaagccacaggtttatctacagttgggttagatggtgataatactttagtgtttaaaaatggtacaaatagcactaacacggcggagttaaaagtcggtggtgcagctttaacattcacctctactggaaatggaactggcggaamtgctmaaaccgtgaaaatctcwaatgtggcagmtggaaaaattgatactarttcaacygaagccattacrggtaaacaacttgcygatttagctactcatttaggggttartgttgatartggaaaaactgggtttacagcaccatcatttgaagttatcaaaggcggtactaaagacgcaacgagcggtaagaatggtcctacaacctttaaaggagcgattgaccagttaatcaccgcagttaatggtggwttgacattcaaggggaatgataacagttcgactaaattacaattgggcggtactttaaccattgatagctcaacggttggtagtggtagtgaaaaagacattacagcaaaactggaaccgtctaatggtaatgattctaaagatgcagggaaattaacattaacgttaaataaagctacttctgtagataaaaatgacgaaaaagtcattacctcaaaagccgtagcaacggagttggaaaaatatacgaaaactgctgatttaggtaatgcgtatttgaaaatagatggatcgaatattggcgatgcttccaataaaaaaacattcggtggtcatgtcggtattgctgaaatcaagttagatggtgaaaaaagcagcactgaattagtacaggcggatgcggttattaagtacctaaaaggtacaggaccagattctgtaaaaatatcagactcaacaaagacaatggctaaaggaaattactcaataagtataggacatgaagccgtatcagaaaatgcagaatcaatagcgataggatatatgactcatgcacaaaataaaaaatcgatagcattaggtaatgaaagtgaggtattgggcgagaaatctattgcaataggtacagagaataaaatagatggtgagggtaaatactcaaccgtattaggcgtagagaataaggtatcaagtaaatttacttatttaataggatacaataatgatatcaaaggagataatacctttgtattaggatctaatatattaacagacaattctattaaaaatgcagtaatacttggagatagatcaaaaggagaagcaaatgcggtatcagtaggtggtgctggcgatggtgaacaacgaagaattgtttatgttgctacaccaacggataaatacgatgcggtgaataaacaatatgttgatggacttggattaaaattcaaaggtaatgataataaagagatacataaaaaattatcagacacattagaaatagttggtaagggtttaaataaagctcaaactactaaatttaatggmacaaatggaaatattgctgtaaaagaaaataaagggaaattggaaatatcattaaatagagatttaaaaggaattaaatctattagtgatagmaagaataaaaatatagctactgaaataagattcaatagmaaaaatrrcacaarcagtattyctaayagtttgayaamkaacctaactatttcttcaaatggaggcacatttgaatttaatagaacaggtttgcatattaacaataaacaaattacagggttaagaagtggactattagaaaaacataatggacaagatagagaaagaaaagatttaaactatttaataggagatgaatttaaaaattcctctattcaaactcatgcagtcaatgttggagatttagcgaaaatttctaaggaaatagttgaaaaaggatataagtataaagctgatattccgtcaaataatagcaatgataccagcataaaactaggctcaaccatatctattgttaaatggacagacacaccggcgactggacaaccagcagtaactgttggcacaggaacaacttctcaaacatcagctgttaagtacacaggagataatttaacaactcgatatacctatgacagtagcaatggcaacgctaaaatcgaaatcgggtttaaagacgcaccgacatttagcaaagttaccttatctcaagctcaaacatatggtaagggtagcagtgttggaaataacgacttgattagcaaatcctaccttgacgctgcattaaaagactttaagtttaatgtggaatatggtggtaagcaagtccaaatcggtcgtggcgatacgttgaagtttgcagacgggctgaatattaaactggagttaaaagaagtcgaaaaaccggcaaatgaggcaacgtctaccattaattcaaatatggaaacttctaccccagcaccaacaacagtaagtaccccatcagatggtgcaaatgatgcagacgtggctacaacaacggcagaggtaaccattgacacgactgaggaattgaaaaacatcacttcgatttcctctaaaggaagtgcgggcggaaatgatgctgactcaactgtagaagtcaccaaacttaccttagaagctgataaaggggcgactttccgagtgggcaacacgggtgctaaagtgaatgtcaatagcgatggtatttccctcacaccgaaaggggcaagtggtacgagtccatctgacgatgtagcatctatcactattaaagcaggctcaaaaccagtggattcaaacagtatagatttacttgatccagctaacggaccttcaatagcgtttgcagccaaaggcggtagtaatggctcaaaagagggaacyggtacaattaaatacctyaaagacagaactgttagcaaaaacaatggcaacggcgataaatacggtgagggcgataacaaaggcaacgcwgcyacagaaggggcggtgaaagagctttatgamtccggyttgaaattcgccggcaatgaaggtgagcctgttcacaaaaaactgggtgaaaccttgtctattaaaggcgaaggtgcggttggtgaaacggcgacggataacattgtggtaagagccaaagagggtgaactgcaaatcggtctgaccaaaaatattagaaatattgacaccatttctatcgctggcacaggggacaatagcggtaaagatgtctttatagatgctgagggtatgaccactactgctcaacttgaagatggcacggtgttggtgaataaccaaacggctgaaggtgtcagtacaatagctaaaaaagaggatggtagcattttggtgaataatcaaacagcagaagcgaatattttaagcaatggcaagcacacgacagaggtgaaagccggtgaggtcgctattaaagacaagagcggtcaagaaatcgtgagcttgaaagtggctgagggtgaaaacggtcaagatggcaagggagcgacgcttgcgtttgccaaagatggcgaaaacggtacaggcgtaatcatgggcttgaaagacctagatgccactgctgacggttcaagtgcagcgaataaaaactatgtggatgaaaaaatgtccgatttggacagcaaccgtccgtttaacttctatatccaagagggcaaagagtataccaaagtcgtcaaaggacgtgatggtaagttttatgatcctgagcttttacaaggggcaaagtatgatgtggacagcaagaaatacattgctcaagatggacaagaagttacaccggaatcggataaagtcattattcgtgctgaaccgactaccgcacctatcgggattaataatgtggcaagcgggttgggtattttggctatagaagaaagcgagaaacaacaacttacgcaagctgttgaagataagaaaaacaaggtaagcgaaagtgaaaaggctcttgctcaaactactgctgatgttaaaagtaaacaacaagcacttactgaaaaaacaaatgagctttcacaagttgccagcgaacgtcccgtattgttgatgcaaaaagctgaccttgagcagaaacttaaaggattgggtgcgagcgatccacgaagagcaaccgcacaggaagctcttagcaaagtggaagagatactcaaacaaaatgatcaaaaatccattgaaatagcaaaagaggttaaaacggcttccgaaaatcttgataaagcgaaagtcgctttggcagacaacgtgttaaaagcctatgcagcacaacaagcattagctactgccgaggaaaccttgcgaaataaagaatttggcgtggataaggtgaaagacttactgtcaggcaattcaaatattgctgaggataatgtggctactattaaagatgtgaaagcacttgctaaagcaggattaagttttgagggcaatgatggtaaacgcttgcataaagatctatcagaaactttagcaatcaaaggtgaagaaaatgcaagtggtgataaatttaatagcgaccacaccgccgccggcaatatcaaagtggaaatggcacaagacggtaaaggcttagaagtcaaattgtctgaccagttgaagaacctcacatcggttgaaactaaaaaagacgaccaaggcagatcaacaacattgctgtcccgtggagtgatggttcaaaatgacaccacaaaagaacaagccctgttcagcgaaaaccgtttagcgttctttaaagatggagcgttaggattgaatttagacggtaagtctcgtgcattgaaagtcggtgaaaaagcgatcatcagtataaacgacaaaggtgaagcattggtttccgatctgaatgaatttagttcaggtatgacaattaccaataaaaactatgtggataccaaaaacaatgagttgcgtacgcaattgaataatactgaccgcactttacgagcaggtattgctggttcgaatgcggcggcagggttggcatcggtctctatgccgggtaaatctatgttagccatttctgcagcaggttatggcggggaaaacgcagtggcaattggctattctcgcatgagtgataatggtaagattatgctacaactgcaaggaaatcggaattctagaggcaaagcggcgggttctgtttctatagggtatcaatggtaaattgattcgattgtgccttatgtccacattttgttattgaggatataaggcataaaaggcgtgctctgttttaaaatcaacttggtagttgttgttcgatttattgacgagttattaagtttggtttctttttacatagacaaggtttaaaatggattagattctgttttaaaccttttttacaactggacaaatcttttaatatcaagaataactgtctgtatctatttcaaatagctatattgctatctatgatgatggaatgttgatcttgatgtttgtagcaaaaaattacatagactttaaacgaggagaagaaatatggaaaaattcgatgttgtgattattggtgcaggaccttctggttctgtttctgcatcattattgcataaacaaggcttaaaggtgtgtgtattggaaaaacagcactttcctcgttttgtcattggtgaaagtttgttaccttattgtatggatattttgcaagaggcggacttggttgatgcggtacatgctgagaaaagttttcaatttaaaaatggtgcggcatttacttggggaaaccgttacacctattttgattttacggataaatttactgccggaccgggaacaacttaccaagttcgtcggggcatttttgatcaaattttgattgatgaaacggcaaaaaaaggtgtggatgttcgttttggtcatgaagtattggcgtttgatcatcagggcgatcgggcggagctgacggtaaaaacggagcaaggggaagaatatcgactgagtgcaggttttgtgttggatgccagcggttacggacgtgttttgccacgcttattagatttagaaacaccatcgcacttgccaatacgtattgcacattttacccatattgatgacaacattgatgatccgatctttgatcgtaataaaattctcattaccacacatcctgaacatcgtgatgtttggctttggttaattccctttgcggataaccgttgttcaatcggtgtagttgggttaccggaaatattggcgggtgagagcgaaactgtgttgaaaaaatttgctcttgaatgtccaatgctgagtaaaattcttgctaaggcaaattgggaaaatgaatttccgtatcgccatattcaaggttattccgctaatgtgaaaacgttgcatggcaaacattttgctttattgggtaatgcagcggaatttcttgatccggttttttcatctggcgtgactattgcgttacattccgctcgactggcaagtcgtcttattgctcgtgggcttcaaggacaagctgtggattggcaacaagaatttgcagatccgttaatggttggcgtgaatgcgttccgcacttatgtgaacggttggtatgattatagtttccaagatgtcatttatgcccgtaatccacaacctgaaattcgccaaatgctttcgtctattcttgccggttatgcgtgggatgagaaaaatccgtttgtggcgaaatcctcccctcgcttgaaagcacttgcggaattatgcggcgaggcaacacaagattaagataacaatatataagcattcaaaaattgctatttgcaaacgttgagtgcttttattttttcataaggaaacaccatgccatcgtttgaaaatctttcttttattaccgcacttttatttttttgtatttgtctcattttattttttatttttgtacgtaagcaaagagaggtggaggcattacaacaagagttagataaaaatattaatatttttaatcaattgctgaataaatatgaacgtataaaagacgaaaaaactcagcttgggcaacaagttgtaaaggcacagacacttgtcgaaagcggtcaaattcgtttgtcggaacgtgatgaaaaaatcctttatttgcaaaaagaattagataaagaacaattacggtgtgagcaagtttctcagctggtaacaggattgaaagagcgtttgggggtagtaagtacacaggcggaaagttttcaacagcagttaaatcaaagtcgtgcagaaaaagaaaagagagattgtgcttgggctgatttaaatcagaaacataccgcacttcaacaagaactgacagaattaaaagtcacgttaagtgaaaaagaaaaaaattttgtcgagcaacaacaaaatttttctcaggctaaacaactgttaagtgttgaatttcaaaatcttgccaatcggatcttggaagaaaaaagtcaacgatttaatcaaactaaccaacaaactttagacagtttattgaaaccttttcgtgaacaaattgatggttttcaaaagcgggtgaacgaaattcattccgagtccttgaaaggcaatgccagccttgaaagtgaaattaaaaaggtgttggatattgggttagctatgtctaaagaggcgaataacttaacttctgctttgaaaggcgaaaagaaaacgttggggaattggggagaggttcagttagagcgtacattgcaattagccggattgattgaaaatgagcattacagcagtcaagtacattttaaaaatgagcagggcaaacataattatcctgattttattttgcatttacccgataataagcagttgattattgacagtaaaatatctttggtagcttatgaaagtgcggttaattctgacgatgaaaatcaacgcaaacttggtttacaggaacatgttaaagccttaaaaaatcatattgatgctttgtctggcaaggattacagcaatttgatcggtatgcgtagtccaaattttgtattgatgtttgttgctgttgaagcagcttatattgaagcgatgaaacatgacagtaacttatttaattacggatatgaaaaaaatgtcattttagtttctcacacgacattaatgcctattttgcggacagtagcgaatttatggcgaattgagcgtggtaatcttgaggcaaaagaaattagtgcaaaagcaggtgaaatttataatcaaatttgcgtagtggcagagcgtttaaataaattaggtaacagtttatccggtgtaagtaatcattataataataccgttaccgcacttgtaggacagcaaggtttggtggggaaagttgagcggttcaaggatttatccgctaaggcgaacaagataatgccggagattgaattgttgcataatgatataaacgttgagaaattaattgccgttcaagctgaagtcgaagagaaataggatttttaggtaaaaatcttttaaaataatgacagttttgacataagagggaatacattatgattattgttacaggtggagccggattaattggaagtaatatcattgcggcattaaacgatatgggacgtcgagatattttggtagtggacaacctgactgatgggacaaaatttgtcaatttggtcgatttggatattgcggattattgtgataaagaagattttattgcctctatcattgctggtgatgattttggagatattgatgcaattttccatcaaggcgcttgttctgctacaacagaatggaacggtaaatatttaatgcaaaataattatgaatattcaaaagaactattgcattattgtctattgcgtgaaattcctttcttttatgcctcaagtgcggcgacttatggcgataaaacagactttattgaagaacgccaatttgaaggtccattaaatgtttatggctattcaaaattcctatttgatgaatacgtgcgtcaaattctgccgcaggctaagtcgcctgtttgtgggttcaaatatttcaatgtatatggtcctcgtgaacaacataagggttcgatggcaagtgttgcattccatttaaataatcagatgttgaaaggagaaaatccaaaattatttgcaggatcagagcattttttgcgtgattttgtttatgtgggcgatgtggcaaaagtgaatttgtgggcatggcaacatggtatttcaggcatttataattgtggaacaggtagagcggaaagttttgaacaagtagcaagagcggtgttgaattatcatggcaaaggtgaaattgaaactattccgttccctgagcatttaaaatcacgttatcaagaatatacacaagctaatttaacaaaattacgtgccgctggttatcaggaagaatttaagtcggttgctgagggagtagcggaatatatgaaatggttaaatcgcaagtcttgatttagcgaggaaaatagcgttaaaagtacggtttaattgggtgttcatttattcggtattccttttaaatctgcaactaaaaaggctattttgctttataatatcggcaatcttcactgttattggtcaaaacctatgaaaattctcgtgattggaccttcttgggtgggtgatatgattatgtcacatagcctatatcaaaccttaaaacaacaatatcctgattgtctgattgatgtattggcaccgaattggtgtaagcctttacttgcacgtatgccggaggttcgcaatgcgattactatgcccattgggcatggttcctttgacttaaaagggcggtatcgaattggtaaatctttgcgtaatcaatatgatatggcgattgttttgccaaactctttaaaatcggcttttattcctgcttttgcaaaaattccgttacgccgtggttggataggcgaaagtcgttattttttgttaaatgattggcgtagtaataaaaatgactatccaatgatggtgcaacgttatgtggcattaggttatgacaaaactgtcttaccgacagcaaaacatttagccattcctaagccttatttgcaagttgatgctcaagagttggaacaaactttagaaacttttgcaaaacaaaccgcactttgtacaaatcgtccggtaattgggttttgtcctggtgcagaatttggtcctgcaaaacgttggccacattaccattatgccgatttagcccgacagttaattgaacagggctatgccgttcgtttattcggttcggtgaaagataaagaggtaggtgagcaaattagtcaagcgttgcctcaaaaattacaacattattgtgtaaatcttgctggtgaaacagacttaaatcaagctgttgatttgatttcagattgtgtggcagtagtgagtaatgatagcggtttaatgcatattgccgcagcacttaacaaacctttggttgctgtttatgggccaacaagtccggaatacacgccgccactttccgacaatgctgtgattattcgtctaattgagggaggcttgattaaagtgcgtaaaagtcaagatagctcggaaggttatcaccaaagtttaatcgacattacaccgcaaatggtcatcgaaaaattacaggattttttaaattaatatgaaagtttgtttgattaaaaccagctcaatgggcgatgtaattcatactttgccagccttgactgatgctcaaaatgctattgctgatctgcaagtagattgggtggtggaagaaaattttgcggaaattccccgttggcattcagccgttaatcatgttattcctctagcaatacgacgttggcgtaaacagatttttgccgctcaaacaagaaacgaatggaaaaattaccgcactttgttacaacaaaatcaatatgatgcggtaattgatgctcaagggttagtgaaaagtgcgttgtttggagcgagtttagcgaaaggggtaaaacatggttatgatcgtcattctattcgtgagcctttcgcctcatttttctatgacaaaaaatatactatttcttatcaacagcatgctgttgaacgtattcgtcaattatttgcccaaagtttaggttatgaattgcctcacgaaaaaggtgattatggtattgcgaagcattttgtgcattcgactgaaaatgcacaacattatgtcgtttttgtccatagcactacaagagcggataagcattggattaatgctgaatggaaaaaattagcccaaaaattgaccgcactaggtttgcaaattcgcttaccttggggtaatgaaaaggaaaaagcacgtgccgattggattgcacaagatattcaaagtgcggtagttttaccaaaactttcattgaccgagttggcacaacagattacctatgcaaaagcggtagtttctgtggatactggattagcacacttgaccgccgctttagatgttccgaatattactttatatggagcaacagatccgaagttgatcgggacgtatggtaaacatcaacattatattcagaaacagggtatggcgttgattagtgcggaagatgtgttgagtgaattacagtcaaaagaaatattgaaattttaaccatagaacatctgcactttgcatttacactaagtgcagatgaatttgattataaacggataacgccgtcataaatatgtgttgcctcgccggtcatataaagtgggtgtccttttccttgccattcaatcattaaccttcctcccggcaaatcgacttgtacgcaactacctaaaacgccctgcataatgccaacggcaactgctgcacacgcaccgctgccacaggcttgtgtttctcctgctcctctttcatacacacgcagtttaatatgactgcggttgataatttgcataaaaccggcatttacacgttcaggaaagcgttcatggctttctaagagcggtcctaatatttcgatgtttgcgtgttgaatatcttccacttgtgttacacaatgtggattgcccatagataccacaccacatagcaaggtttgtatgtctgtgcgaataatataatttttttcaaatttattggcgttaaaagggattttattcggttcccaaatcggttcacccatattgacacataccatgtcatcgtctttaacgcataacatcattttgccttttgcagtactcacggcaatttcttttttattggttaaacctttaagcacgacaaaacgagcaaagcatcttgcaccattgccacattgcgaaacttcactaccgtccgcattgaaaatacgatagtgaaaatccaaatccggatcataaggcggttcaacgactagcaattgatcaaaaccaataccacgattgcgatctgccaatctttttatgacttcagtgggaaaataaacgttttgagtgacagcatctaccacaacaaaatcattccccagtccgtgcattttggaaaattgcatttcctcttccttaagcaaattaaaattggagctattataatcagctgcttaaattgagtaaatgagagaaatcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaattctaaaagcaatattctctccgcactttgaggcggggagaatgttaggttgttgttttgtaccattccaaaataaatgcggcaatttgcgtcgggttgttaatatccagtaaaggaacggaagtctgtacaggataatctgtcgctaacgctattacatattcatcacaaggcggacaaggttttgtcatattttgacgatgtaataaaattttggcgatggggtcttgtttaaacccttctactaaaattaaatctgtcaattggggtgaaaattgttgagcaagataatctaaagtgacaggttttggcgtttcggtcattaatgcccaacggttatcacatgccaacataacttgtgtcgcaccagcctctttcatacgccagctgtcctttccctctttgtcgatttgtgcgttatgatggctatgtttgattactgaaacccgcaaacctaaacggagcaattcaggcagtaatttttccaataatgtggtttttccgctaccgctataacctgtgatacctagcatgggttgcatataaattcctcttttattgaataatgcgtaacagaatgggttgaaaggcctttttatgttgccattttttactgtatgaatggataagcacaaaagaaagtgcggtacaaaaaaggataaaaattgcaccccacaattcttggctaaaaatttggtttgcaatgagtgttgcactgagcaaggtcattaaaggaataatatacaataaaagtgcggtagaaatcagagaactttcttgtaaaccaagctcaacaatttgacctatttttaagggtatcaggctattaacgataaagatatgctccggacttttgccggttaattcagaaagtgcggaagttccacaagtattttttgctgtacattggctacaagcatttttgctttgacatttcactgttgcttttccttgatgataggcaatgactatcgctctttctgttagcataaaaaacctatttaattcgaatatcttgaataatacgtttagcggaaaagagaggaagttgaccgacaaaggttaattctttgttacctagagtgttgctgtaaaaagtggtggagccttgcttccaaaatctttctccgtcattatcaacaatgctgttagacaaatagagtgcaaaagaaaatagtccgtcactataaaattggctctcaatagggtgtttattgtctttttctattgttatggattgactaattaacttaaacccttttgggagccactccggtttccaattttgttgttgagttttcggttcacttaataacggaggaaaaatgacattatctatatagctacctaattcgatcagttcatcaccaagatataaattaactactcggaactgctctaataaattgccttcacgatccaacatatcactgcgtagcaacaaatgattttgttcatcgataaagactaaatattgatagcgaaaatcgtctttaggcaaaatacgtaaagtttgtacaatgcgatccgccacacgattacgcccaatggttacgatatcgtaataatctgataattgcttaacatcactccacattacaacaggtaagttatccataatatgaccgctctttaaagagaatgcttggaaattaggtggaaaataactcactaaattttcatgttggataatttcttgttgaacaccatctaaggtaataagttgggcgtaacttttgccatcctgattaatatgacgataacgaagtgaatctatattggttggtgtggcttgtacaaaataaatttcataatttaatgtattttgtgctgcaatcattttttccaataattgctcaggttctatattttcttgagcgaaagttgaaactgaaaaagtaagaagtgcggtcaaaaaagagaaaatttttaacatagtattcttcctaagaaaaaaattcaccaccaaacggtggcgaatatcttaacatgaattgagctaatgttcattatttggcaatccgaaactgtcagtatgcagacgtcgctgtaattcatagttttgtaacattatgccaatacgtttgttccgttgttctacttgctcttgcgtaattatttcttttctcggaacattatagctgatttcttgtaccgaattattaaatggaagcgtttgtagagttggggtatccagtgtatttttgcccgctctttcatgattaaaagattgaacgccaagtacggcaacgaaacaaaccgttgcagcaactgccatttgtaacattggggaaaagaatgagcgtattttttgtataaacggaagtttttccacttctgcgagtgtcggttgagactcgagagaatgttcgatttgtattttttcttcctgttcaatgagcgttcccattcttgctgtgaaatcagaacctaacagcactttactttctttgcgtataatggaacgaattaaatgataatttgaccaactattttgtaaatctttgttttgacaaagggtgtcagtaaatttgttaccacaatgctcaccatcgatataagctgaaagtaactctttttgcatctttaactccaagtctttgcttattaaactatttaacgttgtatcaaaggttgaattttgctttcgattatttctcttgcacggaaaatacgagaacgtacggttcccaccggacaatccataatttctgcaatttcttcgtaactcaatccttccatttcacgtagtgtaatagctgtttttaaatcttcttgcaggttactgatagtatcaaaaacaacttttttcaattcactggataatatttcattttcgggagtattcacgtcccttaaatttgtaccaacattataactttcagcgtcttccgctaatatatcctctgttggcggacgccgtccttgtgccgttaagtaattctttgccgtattaaccgctattcgatatagccaagtataaaaagcactttcgccacgaaatgattcaattgagcggtaggcttttataaaggattcttgtacaacatcgggaatatcgttttgtgaaatataacgagtaagtaatccggcaactttattttgataacgagcaaccaataagttaaaggcctttttatctccctgctgtactttttctaccaaagcctgatccgttagttgttcagccatataacctcttgtatcacatctaacaagccttaatattaaagccagccaacccttgtgcttgttagacgtaatggaataaaaaaagttcaatctttttaggaaagattattgatataaatttaaattttcttgaatatgatctaccatctcttgtaattcaagatcagcagccggagttttgttaaaaaaccaagaaaaaagttgtaaatccgagcaagctaataaacgcaaaaatatatcttttttagcatcaggtagttcatcaaaatattgttgaaaaaaaggcataataactttatctaattccaacatgcctcggcggcaatcccattcaatgcggaatttgttgtatttttccatgcttaatttccttttatctaattttcttgttaatagtaacaatcggaagaaacgctgtaaataaaagagaagaataaactcggttcggatagattttaggtgtgcaatataaatggcatacaaataaggcgtattatatatcaatacgcctttgctcttaggtgtaaatccctttaacttttaaccagctctactacttcacgggttaatcgtccaatttcttcccattgttgggacttaatcaaagatttctctacaaaccaagagccaccgcaagcaactacgtttggaatagcgagatagtctttgatattttgtggcgaaatgccaccggtcggcataatttgtaagttaccgtaagggccaagtaaggcttttatcattttaacaccgccacttgcctcagcagggaaaaacttgacagcttgtatgccgagttcaagagcggattcgattgccattggattatttaccccaggcgttacaggtatatttaactcttgacaatacttcacaatatttggattaaagcctggagtaacaatacaatctgctccggcatttttggcagccaatacctgttctttggttagcaccgtgcctgcagctatgagtacttcaggatattgttggtgaaccaatttaatggcctcttcggcagcttcggagcggaaagtaatttccactacaggcaagccgttttcagacaatgtttttgctaagggtaaaatatcctctgctttatctaaagcaataaccggaacaactttaagctgtttcaacttgtcaataatttgttcagtggtataacgcatttttaacctcttttttaatgtgaaaaaatttctttaaaatggttattttatttgaaataacgttttgcattgtcatagcaaatgtctttcaccatctttcctagtaggttgagatcatttggtgcttcgcctcgttcaacccagccaccaatcatttcacataaaatacggcggaaatactcgtggcgagtgtaggataagaaactgcgggaatcagtcagcataccgacaaattggcttaatagtcccaattgtgagagttgctgtagttggcgttccataccatctttttgatcgttgaaccaccagcctgaaccgaattgaattttgcctgcaatgccaccggtttgaaaattgccgatcatggtaccgagcatttcgttatcacgaggatttaagcaatataaaatagttttcggaagttgatctgtttgatccatactgtctaataagcgagacagcggttcggcaaacaggcgatcgccgatcgaatcaaatccggcatccgcacccagtaatttaaacattctcgtattgttgttacgaattgctccaatatgcaactgcattacccaatggtgtttgtggtactctgtacctagccaaactaacagtgcggtactgaattgtgcgatttcttcttcttgrgttgattgattttttaatcttttttgcagaatgccgtcaagtgttttctcatcaggaattggtgagaaacggacaatttcaataccgtgatcggcagatttacagccacattgatcgaaatgttcaatacgtttcgataaagcttgttttaatttgtcgaacgtgttgatttcaatatctgcgacttttcctaattgttcaatataatcattgaacagcgggagttcaattttaaacgcacgatcaggtcggaaacttggtacaacttcaatatcaaaggtattatcttctgcaatggctttatggtattccaatgaatcaataggatcatcggttgttcccactaaacttacattcatttttttcataataccacgtgctgaaaattcaggctgttgcagtaactctttccctttatgccaaattttctccgcagtttcgggtgaaaaaatcgtattggtaataccgaacggacgacgtaattctaagtgggtccagtggtaaatcgggttaccgatacattttggcacagtgttggcaaaagcgagatatttgctgtatttatccgcacttcccgtaattaaatgctcttctacaccggctgaacgcattgcacgccatttatagtgatcaccctctaaccagatttcagccaaatcattaaattggcgattttctgcaatctcttttgggtttaaatgacagtgatagtcaaaaatcggctgttccttggcgtagtcatggtaaagcttttgagccgttgaagttgatagtaaaaaatcttccgtcataaatttcatcattatgtcctcttattgagttattttttgttccaatacacttgcattttcatctactttttctttagaaagcggataaacgtatttcaacagtaaaaaaatcaagaggcaagccaatgcaggtactcccgttgcaaagttatagattgactctaacacttcttgtggttgttgtgggatttttgcagaatagccaatgtaacttagtgcaaagccacctaaaccaccagctaaagcttgaccgattttgcgagcaaatgaataaactgcataaattgtgccatcttcacggcgtccagttttgataaattggttatcaataatatctgtaataaatgcccatataataatttggaaataacttagacctagtgttgcaatgagtgcgacaatgataaataaccaaacatttgtgattttaacgaagaatagcacactgtatatgacagcagttatcaataaacctacagaagctgattcttttttaccgtactttttcacaatattttgggcaaacggagcaactataaatgttgtcacggcacctaaaataccaccaaatgacaatgctaatttactattaaagtaatcaacatacaaatatgggttcattgtaccgatgattaaggttgctagcagtaaaatgatagcgattaaaataaagataagtaacgcactgtttgagaatagactgctaaagattgcttttacgtcatctaaacagtctgatttattgtgtgatttgttgtggcgacgaccttctttttcaggcaattgaactcgctcaaccgaaaatctccaacagatttggtacaaaataaacgcacagatcataaatgctcccataatgtatgtgaacatttctgggataattacttgtttaccctcaacttctttgtaaataatgagtggaattacaaatgagataaaaagtaccgcaatatttgcacccactgtacggaagatagataatccggcacgctcatcagcttttgtagtaatcacggaagccattgaaccataaggaatattgaccgctgtataggctaaactaccccaaactatgtaggtaacagtgatgtagaccaattttgcggtataagaccaatctttcacaatgtgtaagaaaagcagaaatcccgaaatacagataaagggagttgcccggcgaataagacctctgaaacgcccctctttaaaaggctttatagtatctactaaacgtcccataccaatatcagtaaaagcgtcaataaatctagaaactagaaatagaagaccgacaacataaccttcaatttgtagcacattagtataaaatagcattaaaaagaaggcggacatcataaaactaagatcattagcaatatcgccagccatataggcaagtttgtcttttaaaccaaaaggtctttgtgttgaactcataaaaactccttgtgaggaatatagattaaatatgggtatctttataaccgcagaacgcatcaactgggctaatacctttaaactcggaattacccattaatttttctaccagcaattctatggttggctctttgccgtcataagcattgatgtaagtttttacttgaggaacatcaactaaatggaacgggcattgaacggaaacgaaaattgttggtacttcatgtacatagaatggaatatcaggcgttcctttggtcgcttgccatacgatacgttgaactgtactcatttgcacattcgcaacattgataatcagatcataatgatcggttaatgtcgtaattgggcgtttttgggagtattcattacgaatagttttgacctgttcttcgtccgacatcttgagaatattatccatcggtgatgtataaatagaaactgtaaatcctttttcttccagtttttcttttaagatttctgttgcactgcgttgactacctgcaaccattttaccgaagccaccatctgtacctttaacatttacaagtaagattctagggaaacgttcaacattaattgggaaaatatcttgtttatgtttaactaaggtaattgctttatctgcaacatcacggaaaattgctttatgttctggaagtcctatttttgctaatgcttgttcttttggttcaagcaatgtttctcttgggcgattgtgtaagcctaattttgcttttaaccctagaatacgagtaagggcatcatgaaggcgttcttcggtaataatgccgtttttataaccttccatcatataaccgaaatcttcatcaggatcgttaaagaaaaggaataaatcacaacctgcagcgatagcagtcggtagcatttcgctacgcttcattgctgaagtcattgctaccatatggctggcatcagtaacaacaacaccgttgaaacctaatttacctcgtaataagtctgttaaaattggttttgaaagtgtcgctggtaggcagtcctcataagctaaatttggattgaaatgctgctcgtaagcaggtaagtgtatatgacctgccatcaacgatggtaaaccggcatcaattaagccttgataaactttgccgaaagttttgtcccactcttcgcaactaaaactgtttacactaaaagaaagatgctgatctctttcatccactccatcaccagggaaatgttttgcagccggggcaataccactttcttgaatacctttcatataagccaaggacatttctagtactttctctggatttgaaccaaatactcgattagaaataattgggtttcgccagttataactaatatcaacgataggagcaaaactccagttacaaccgatagctgctgcttcaataccagctacacgccccatttcataagcatatttagcatcatcggttgcaccgattttgacttgtaaaccaatttctgttccatcactgcaagcaccattaccaccagcttctgtattcgctgcaattaagagagggattttacttttagtttgtagaatatagttttggtcataaacctcctcagcaggaccgggattataacgtaccgcaccaatatggtaacggtttaaaacatcagtgagatattcctcggatctgcttgaacccatattcacaaaaagctgaccgattttttcttccaacgtcatattagctatagtgttttttacccattgaatatcttcatcttttaagtaataaggttttttcgttaaatcaacagacataatttctccttgcttatttgtcaaaatagtaataattgtgatcaagcggttaaatttgcattaaattttgcaaccaattgggcttgatattgagaatcaaatttttggtaaaccaatttccctaatgtttctaatactaactgatcccaagattcatcttcattgccacataaaatcgggaagaaatttacacttgcttcattggcactatttaaatcacccggcgaatcaccaaccattaaaatattgttcggttgatagccatattgtgctaattggtttaaacaatgagtttttgtaccctcatcttgtccataaactagatctacaaaagggagcaaaccatgtcttgtccattcatcaagaatagcttcattatttgcggaacttaccacagcgatgtctgcaaactctttaataatggcgagggaacgtttgactaaacggaacggtttatcttgagtatgtagagttttaatacccatattgactttttccgaccatgctaacgcaagttttagatcatcggtatggttgtcttgtattgcttgaataagtgaacgattggataattccgaagttgtatttacccagtgttttaattggctgaaatcctgttcataaccatactcttccaaagaaagaatcaatcctttgaatcgattgataccacgtgtttgagagtaaaggttaattctattccaaatttcaataaaacgtgcttcatctgtaagtccaaaaatttcaacagcataaggtccgaaacacttatcatgtttaatgttcattgtatccattgcacaaccgtcagaatcaatgcacacaataaatttatgttttggtataaacgttgtcattattttcccctatacaccgctgtaagcagagaaaccgccatcaatcggcaatactaccccatttatgaagctggcataattttcatccattaagaataaaattccacccatcaattcatgtgcttcaccaaaacgtcccattggagtattagttaaaattttattagctcgagctgtcggatttccttcactgtcaaaaagtaatcctctgttttggttactgactaaaaaacccggagcaatggcattacaacgaatacctactttagagaaataaacagcaagccattgggtaaagttactgatagccgcttttgctcctgaataggcaggaattttagttaacggagtataggcattcatgctagagacattaataatattagccccttttttgccgatcatatctttggcaaatacttgagtaggaagtaaagtacctaaatagttgaggttaaatacaaattcaataccatttttatctaaatcgaaaaatgattttgtactatctgctaagttaaattcatgaaattcattgtcggttgttgcttttgggctattaccaccggcaccattaatcaacacatcacaagttccaaagtctttttcgatagcatcacgagtttgttgaatactttccaaatcaagtacattggttttgtatgcttttgcaatgccaccattttgtacaatagcttgtgcatattgttctgccgattcgaggttaatatctaataaagcaacttttgcccctgtttttgctatttcttgtgcaaaaaatgcacatagcactccaccagcacctgtaataacaacgactttacctttgaaatcatgattgtttgcaatattcatatttttatctcctattaagattaattgatatgctaaatatacgtctatttttaaaactggtaaaccagttattaataaaagtgtgatttacatcacaaaatttaaacttttttggtttaccttttggttttttatgtaaaatatgcttaaattatagttgttttttggtgtgagaaatgttaatttggtgaaccaaaaaggtattttacgaacaccatcaagaagtcaaaaaagcagagagacaaaaaaatgatggcaacatcacctgaagaactacgttcttataaaaaaatagggcaagaattaaaagcggaattattgagaggaacttatggtattggggataaattaccggcagagcgtgatttatctcagtacttcaatgtcagtcgtactgttattcgtgaagcacttatcatgcttgaacttgagaatttagtcgaagtgcggaaaggatctggtgtttatgtaataaatttacctaaatcgagttcagaggaaactgaagatttgcctgatgttggaccctttgaattgctacaggcaagacaattgttagaaagtagtattgcagaatttgcagctattcaagcaactcgagctgacgttttacacttaaaagagattttagatcgtgaacgtagaactttagagtgcggtgatgatgaagattatattgcagatgaggattttcacaaagcaattgcagaaataacgcaaaatgaagtggtgatccgcatgcaaaaggatttgtgggagtaccgaattaatagtcctatgtggaaaggtctgcatgcacatatctctgatcaaagttaccgctatttatggttaaaagatcacgaaaatattattgttgcaatacagcgaaaaaatcctgtattagcacgaaaaatgatgtggcagcatttggaaaatgtaaaacagaaactgtttgaattatcggatttagatgatcctaattttgatggttatctgtttaatgttagccctttggctgctgatttttaattagatgaggaatttactatggaacaaacatggcgttggtatggaccaaatgatccggtatctttggatgatgtaagacaggctggtgcaacgggagtggtgactgcattgcatcatattcccaacgggcaagtctggtcagttgaggaaatcaataagcgtaaagcattgttggaggaaaaagggttggtttggtcagttgtggaaagtgtacctattcacgaagatatcaaaacccaaacaggtaactatcagcaatggattgataactataagcaaacattgcgtaatctagcgagttgtggcattgacatagtatgttataactttatgccggtgttagattggactcgtaccgatcttgagtatgaaatgccggatggttcaaaagcgttacgttttgatcaagtggcttttgctgcctttgaactatatattttaaaacgtccgggagcagaggaaacttactcaccggaagagcaagcagaagccaaagcctattttgatcaaatgagcgaagcggatattgcgaaattaacaaaaaatattattgctgggttaccgggatctgaagagggttatactcttgaggaatttcaagcacaacttgatcgctataaaggtatttctacagagaaattccgcactcatttagcctatttcttgaatgaaattgtgcctgttgcacaagaagtgggaatccgtatggctattcacccggatgatcctccacgtccaattctcggtttgccacgtattgtgtcaactatagacgacatgcaatggtttgtggatactcaaccgcttgccgctaatgggtttactttctgtactggttcatatggtgtgttagcagagaatgatttagtgaaaatggcggaaaaatttgctgatcgtatttactttgttcatttgcgatccactcagcgggaggaaaatccacgaagttttcacgaagctgatcaccttgccggtgatgtaaatatgtttggggtaacgaaagcattactcaccgaagaatatcgtcgcaaggcaaatggtgataatcgcttaattccaatgcgaccagatcacggtcatcaaatgcttgatgatttgaagaaaaaaactaacccgggttattctgcgattggtcgcttaagagggttggcagaatttcgtggtttagagttggcattaaaaaaagtgtattttaatgactaattaaagaataaaggtactaagtgtcttagctgggaagtatagttctagacatggtgtgaaagaaacccgacaaattgtcgggtttctttcatctaaaagagaggtctgttttatactattttttgtttgacagaagaataaattacgccggttatcaaagacacgatgctacttacaacaagataaaaagaatctgttaatcattttaggttattagtatattattttacacaaagttttaaaatttgttcgctaccctgcacgagatattgatcatcttcagatcgtactcgattatttttcaagtctaacatggcatcataaataccttgtgtcagacttgcttgatcaagatgactccaacaagttgaacttaatctattaaagttggtttgtaatccgaaagcaaagagaataccgctataataagtatgcacatcgctgtctaatccattgcgttgaaacagtttttctttaatttgattgatcgagactgaaatttttgcggagtaccaatcttttacaccactggcaaaagcgttcacatgatattctttgttcacacgaccttggtaactttgtactgtcaccgcataagcagtggcataagatttttgatctattttatcattgtccaagttaatcaccgtttttatattgttttccgatgaggtataagaagtaacagattttaccgagcaagctgaaatcagcccaatacataaaaataaagatactcttttaaacataaaattattcccaaagaaaaaataaattaattgtacagacggatcggatttaagccaacaaagaaaattcaccgcactttctcatttattctcaatctttaaaacaaaatctaaaaatgctatattgtacgctgttttttctgactaacctcaattatttatggctaattatcaagatataacatttgcccttgcgggtgtgtgccaagcggcaaaattagtacagcaacttgcaatgaacggtacggttgaccaagaaattttgcgagctggtttaagtacattgttgcaaactgcaccggaagatactttagccgtttatggagggcagaaaagtaatttaaaattggggttggaaaccttaatggaacaattaaacggcagtgatgtaactttaaatcgctattggttaggacttttggctttagaaggtaaattacataaaaatgcacaagctaaatctgaactggctcgtcgtattcagtatttgcctacacaacttgcccattatgatttacttgatgaacaaatgttatcaactttagcttctatttatgttgatgtgatcagtcctttaggtgctcgtattcaggtccaaggctccccgctttatttacagcaattaatgacacaaaatcgtattcgagcttgcttgttgactggtattcgttcggcggtactttggcgacaagttggcggtacgaaatggcaatttttgttttcacgtcgcaagctggtagcaacagcacaacaaatttattcatctatttaactgttcttaggagtaattcttttatgcaattcaacgcattgaccgcactttccccgatagatggtcgttatcaagacaaagtaactgctttacgtggcatttttagcgaattcggtttattgaaatttcgtgtaactgtcgaagttcgttggttacaaaaattatctgcaacaggcactattcaagaagtttcttctttatctaaagaggcaaacgattacttaaatcaattggtagaaaatttcagtttgcaagatgctgaacgcattaaagaaattgaacgtattacaaatcatgatgtaaaagcggttgaatatttcttaaaagaaaaaagtctggcaatacctgaattagtggcgattagtgagtttatccattttgcttgtacttcggaggatatcaacaatctttcttatgcgttaatgttaaaaaacgcacgtgatgaagtacttttacctgagtggcgtaagttaattgatgaaatcactcgccttgctacagagtataaagcaattccattattatcccgcactcatggacaacctgcctcacctaccacaataggtaaagaaatggcgaatgtggtatatcgcttacaacgccagtttaaacagttacaacacgtggaaattctaggcaaaattaatggtgcggtaggaaattataatgcccatttatctgcctatcctgagattgattggcatcaatttagccaagaatttgtgacctcattaggtttaacttggaatccttatacaacccaaattgaacctcatgattacattgcggagttttttgataatgtagcgcgttttaacactattattatcgattttgaccgtgatttatgggggtatattgccttgaatcatttcaaacaacgtactattgccggtgaaattggatcgtctaccatgccgcacaaagtgaatccgattgattttgaaaattcagaaggtaaccttggcttagcgaatgctgttatgtcgcatttaggtgcaaaattaccgatttcacgttggcaacgtgatttaaccgactcgacagttttacgcaatttaggtgtggggcttggttattgtttaattgcttatgcggcaacattaaaaggtatcagcaaacttgaggtaaatgaaccgcacttacgtgaagaattaaatcaaaattgggaagtgctggctgaaccaattcaaactgtgatgcgtcgttatggtattgaaaaaccttatgaaaagctaaaggagttgacgcgaggtaagcgtgttaatgcagaggcgatgcgtgagtttattgagaagttggaaattccagctcatgaaaaagctcgtttaaaacaacttacaccggaaacgtatatcggtagtgcaattagtttggtggaaaaattgtaaattcggtgtgtttgtcttggctattgccccttagtataaaagcgtatcttagctacgtaaggggcaaatttaagacacttcagataagatttaattcaaaaatagacttttgccggttaagtttaaaaccttctcttattaataattccggttgttgcagattttgttccatgactaaaagtgtcgattgagtataactgacaaattcttttgcttttgcaataagtgcggtgtaaatttcactcttattttgggtatttttgacaaaaatatcatttaattgccaatagcgttgcagttgtaatgaagaaaagcgaggatagagttgaataaagccgacagggttttgctgattatcgacggcgagaaagaagatactttcactaaatcgaattcggtttgataaaaaaataagagttcgctccggattttctatcatattatgggtgaggcggtattgttcaaataaagacaataaagcgtccaaattccatagttcagctttaaatattttcatttctcaataattgttcaaaatttatgaaattcatacagtagattttatctttttaatacgaaataatcatcttttatgaaaaattttttatggatacaggaaaatttttgcaaaaaagagtatagtactgacagaatttttttattaattattatggagaacataaaatggctcgtcgtcctttagtcatgggtaactggaaattaaatggtagtaaagcctttacaaaagaacttattaccggtttaaaagatgaacttaatgcggtgtcaggctgtgatgtggcaattgcaccgcctgtcatgtatttagcggaagctgaagctgcactggtcagcagtgatattgctttaggtactcaaaatgttgatttaaacaaacaaggtgcatttaccggtgatatttcaacagaaatgttaaaagactttggtgtaaaatatgtcattatcggtcattctgagcgacgtcaatatcatcatgagagtgatgaatttattgcgaaaaaatttggtgtgttaaaagatgctggtttagttcctgtattatgtatcggtgaaagcgaagctgaaaatgaagcaggcaaaacggaagaggtttgtgcacgtcaaattgatgcggtgatgaatacactaggtgttgaagcatttaacggtgcagtaattgcttatgaaccgatttgggctatcggtacaggtaaatcggcgactccagctcaagcacaagcagtacatgcctttattcgaggccatattgcaaaacaaagccaagccgttgctgaacgggtaattattcaatatggcggttccgtcaatgatgcaaatgcagcagaattgtttactcagcctgatattgatggtgcattagttggcggtgcatcgttaaaagcgtcagcgttcgctgtcattgttaaagcggcagcgaaagcaaaaaactgattttagttcattcataaaaagtgcggtaattgataccgcactttttagtattcatattagtattcataatttctcgttttcttaatgtctaaaatttatgtggtcttttttttatacctcaataatgtactgtattcagccatttgtcttggtgtataaccttatacgcagttttaagtcgccgaattatcgaaaacgtattttagaacgttacgctttttatccttcgctgactgaaccgaagccgaatggggttgtgattcatgcggcttctgtgggggaagtgattgcggcaactcctttagttaaaaagatacaacagcaatatccacatttatctataacgtttacaacggtgacaccaacgggatcagatcgtgtcaaagccgcttttggtcaatccgttttccatgtttatttaccttatgatttacccgatgcaattttgcgttttattgattttgtaaaaccgaaaatgtgcattgtgattgaaacggaaatttggccgaatttaattaaacaattatatttacgagatattccttttgttattgctaatgcaagattgtctgaacgttcggcaaaacgctatggctgggttaaagcacaattacaaaatatgtttagtcagattagcctgattgcaccgcaagacgaggtaagcctgcggcgttatattgatttgggctacaatccgtcaaaattaaaattgacgggaaatatcaaatatgacttagtggtgaatgatgaattagtgcaaaaaattaccgcacttcgtcaatcttggagtcaaaatcgcccgatttggattgcggcaagcacccatgagggcgaggaagttatgattttgcaggctcatcaaaagttgctaaaaacttatccgcagttgttattaattttagtacctcgtcatcctgaacgttttaatcttgtcgcagagttaattgaaaagcaaaagcttaactatattcgccgttctgcacatgttaatcccgatttattaacacaggttgtacttggagataccatgggggagttgatgttaatgtacggtatttccgatattgcctttgtggggggaagtttagtcaagcatggggggcataatcctttagagcctctcgcttttaagttacctgtgattagtggtcaatatacttttaattttccggtggtttaccaaaacttatcagaggttcaaggggtagtgttagtcaatgaaaatagccaagagctggaaagtgcggtaaaaaatttgttatcttctcctgaattatgtgaacgctatggtaatgccggttatgaagtattggtccaaaatcgtggtgcattacaacgactatttgaattactacagccttatttggagaaagaataatgacaacggttatttatcctggcacttttgatcctattaccaatggacatatggatattattcagcgtagtgcggtcttatttagcaaagttattgttgctgtggcaaaaaacccgagtaaacaacctttatttaatttagctgagcgagttgaattagttcaattgtctgttgttcatttaggcaatgtagaggtaattgggtttgatgatttattggcaaatgtggttaaagcaagacaaattgatgcgattattcgaggggtacgcacgacaatggattttgaatatgaatcacaacttgcacatttaaatcgtttgttgacgaatggtgtagaaagtttatttttacccccgaccgagcaatggtcttatgtttcttcaactattgtacgagatatttttttacatcaaggtgatgtgtcccgattagttcctgcagcggtattacgagctttagaaaagcgggctaaataatttgatgagattttattaaataatccttacattatgtatgtttaaaacactaaaactaaataggaaataatgaatgttgaataaaatttttgtgtggtttgaaagtcgtttaaatccttatccggaacagacattcaatcacctacatcaaggtctgtttcgatttatttggtcaaatttggaaggaatgaaaaaatggattttcctacttgctttcttatcgttcggattgggggcaatggaggcaattcttttccaatttatgggcgttttggtggaatggctcagtcaatatgacgtgcaaactttatgggtagaaaaaggtgcttatttagttgggatgttgattttattgctatttagcattatatggtcttttttagcatcagctacacgtttgcaaaccttacaaggtgtttttccaatgcgtttgcgttggaattttcatcgtttgatgttggggcaaagtttaagtttttatcaagatgaatttgccggtcgagtgtctgcaaaagtcatgcaaacagcgttggcattgcgtgatacagtgcttactttggcagacatgatggtttatattttggtctattttgttacctcaggtattgttttagcagcattagatatatggttattagttccttttgttctatggctaatagtttttgtggttattttatggattgttattcctgaactggctaaaaaagcagaacaacaagcggactcaagatcattgatgacaggtagaattactgatgcttatgccaatatttccactgttaagcttttttctcatggtgcaagagaggcagcttatgcaaagcgatccatgcaagattttatgatgactgttcatgcacaaatgcgtcttgctacttccttagatactctgacttatagcacaaatgttgctttaaccttgagtaccggaattttagggattgcgttatggggaaaagggttggttggtgtgggtgcaattgctactgcgttggcaatggcactaagagtgaatggattatctcgttggattatgtgggaaatggcacgcttgtttgaaaatatcggtactgtaaatgatggtatggcaacactgacaaaaccgctaactattgtggataaaccggacgcacaagatttggagattaaacaaggaaatattcattttaacaatgtagactttgcttatacaccggataagcctttactaacaaattttaatttacatattaaagccggagagaaagtagggctgattggtcgttccggagcaggaaagtctacaattgtaaatttattactgcgattttatgaaactcagcaaggttctatcactattgacgggcagagtgtcgcagatgtttcacaagaaagtttacgtcgccaaattggtttggtcacacaagatacttctttattgcatcgttctgttcgggataatattgtttacggtcgtccggaagcgacagaagaagaaatggttgaagctgcaaagcgagcagaggcggcggagtttattccatttttgagtgattctcaagggagacaaggttatgatgctcatgtgggagagcgaggagtaaaactttccggggggcaacgtcagcgtattgctattgctcgagtgatgttaaaagatgcaccgattttgttactggatgaagcaaccagtgcgttagattctgaagtggaaatcgctattcagaatagtttggacaaaatgatggaaaataaaacagtgattgccattgctcatcgtttatccacaattgctgccatggatagattaattgtattggatcaaggacgaattgttgagcaaggcactcatactgaattgctggagaaaaacggtttgtatgcaaagctttggcaacatcagagcggtggatttttgagtgaatattagtcaagattttaggattaatcaaagacgctaaaaaggcggaaatgtaagatttcaaattccgccttttgctcctcaaacagtgttatttaaatttgtcggcataagcagagctgttgatccactgatgatcttgttcccaagtaaatttccatttacgtacaggtcccgccataacattaaggtaatagttgttataaccggcaatagtggcaactgggtgataaccttttggtaccagcaccacatcgccatcatataccgccatacattcgtccaaagtgcggtcgtccgtatagacacgttgcagagcaaaaccttgtggtttatcaaaacgatgataataactttcttctaagtaagtttcatcaggactatctttttggtcatgcttgtggcttgggtaggaactggtatttccttcatcagtaaatacttcaaccactagcaaggcatctgccttttcggtttccggcaagatattgtgtacaaggcgtttgttattaccaaaaccacgtcgttctactcccacttgttcaggggtaattaaacgtacaggcaagtcaccgttacttggtgctcgacaaacagccaactctaaataagtttcagctttaatttctatttgttgatggtgtggagcgtacaccgaataaggcggaattttctcaaacggtgtagttcgattaccaatattattatatgtttcaccgccagctgagacagtggctttaccacttactaaaacaaaacaagtctcagtagtttctgtattaaaacttaatgtctgccctgcttgcaaatgatacatttcaaaaccgacatattcccaacctgcactttttggtgtgattttttgtacttcaccatttgcagcaggattgtctttgcgtgatttagataataagtaactcatattttccccaaagtgatcatattgataaaattttgccgaaatcataccgcacttagtaaatttcgctatgaaaaatatataaaaaccagatgtagatcacaaaataattattttacttctattagaatttgataaaaatgttttatttatgattttttttgcagtatataaactaggcgttttataagatttagtagtatagaaatctttgttaattaaaaataaaggagttttgtatgaaaagctttttgcaaaaatatgggtttaccccagcctcattttttcaactcattctgatcactgttaatgcacaattgatttatgctttttgggatattcgtaatagcgtacctggtggttttcctgccgctttaggggtaacggatcaacaagccggttatttatattctatgcaaggacttgtaattattttagggactattgctttaggttgggttggtgaccgtttttcaattcgttctattatgttgctatctacggttggtgtgggtggaatttctttatttctaaccctctcatctccaggacttagcatgcctgtgttactggcttgtttcttctctatgttattttttagtgaggtattatttaaaccggctaatttcaaagcattaagaatttcaaccacggaaaaacatcaaggtatggtgtttggattatttgagtttggtcgtgggttgcttgctttccttatctccttgttatggacggtgatgctttattataaagtcggtccgaaggcaatgatgatgacaagttgtattattgttattattactggtattgcagtgttttttattgtacctaaagatcaaaaagtcggagatgaagatactcaagttaatacgaccaaagaagctattcagggtgttgctcgtgtagctaaattaccggttgtttggattgccggaattaatgtgttctgtatttatggtgcgtttgttgccgctgggacctattttgcccgttttttacaaggtggatatggtacaagtgcggttgctgcggcagtttttgcaacagtagttattgcattgagaatgttacctttggtttcttccgttttagtagaaaaagtctttgcttctaccgcacacttcatgcgaatgatgcaaattattttagtggttattctttctgtaattggaattatcttttttaccaatcatccagatatttctttatatgctgatggttatattccagataataccccggtaggactcatttcttccagtatgttctggacactggtagttcttatgttatgtgcatcagcttgtatcttcatgattcgaggtgtttattatgccccaatcggtgagatgggggttgataaaaagcattcctcagcagcaatgtctttcgccattactattggctattttcctgctttattagcaccaattgtattaggtggcttggttaaatcaccggcaaaagatgctacaggacaaattatccgctcttatttaactgatacgcaagtgttagcttgtgctttctttgggcttgcgattcttgcattaatttctgtttttatgtcacatactttaattaaaatgaaacagaaacagcaattaaaaactagtaatcaataggcggttttttatgaatggtcaaaaaataataggaagtcagtgtattacgcaatgtaatcccgatcttcgcattaccgaattgattattccaggaactcatgactctgccacatcaacgtgttatgaacgttattatcgaacacaggatttatcaatagcggagcaattggattgcggtgttagatttttagacattcgtttacgcaaagaaatggttgcagcccatcgagaatgggttagtgatattcgagcagaggaaatttttgaaaagtgcggtgagtttttacaaaaaaatccacaggaattcgttttaatgcgtattcaaaatgcaaatgaacggaaagatgattttcctgaatatggcgaagcgttgttgtcaaaagtacagcaatataaatctttgttttatgcttgggagcattctcaaattgttcaagatggcaatccaaaatggccaactattgcacaagcggctggaaaaattgttccgatcgaatgtgctccgccaagtatgtcaatcaacaaaataaacggtgaattatgggcagccaattggcatgataattcgcagattttgttacaagacttgtgggatggtccgacagtagaagaaaaatgtgtagcaattaaaacgctgattgaaaaaggcagagaggtacactcggacatactgttgttaaatcatattagtgcaactaatggtgaattgcagtatccagatgcttatgcagcatatttgaatgaatactctagtcgattatggaaacaattggcgaaacgtagttttagaggtgtgcagatttatgattttattaatccttctatctgccaagaattgttgcgattaaattttgattagttgagttgatagatttagcaaaaatcaaatctagatcacaaaaatgaaataaatatttcgttttcaataaaatgaattgaaaattttattccattgatctactctaaagacgtagcaagaaatgctttgtgattgagcaaaaatacttaaggagaaaataatggaaacggttttgaactttatcaatggtaaacaagtagcaagtaaaggtactaaagcttggcctatttataatccagccacgggtgagcaaattcgccaagtaatgatgagtactgcagaagaggtaaatgaagcggttgaagttgcacaaaaggcatttcctgcttgggctgcgacttcgccacttcgtcgtgcccgtgtaatgtttaaatttaagcaattgttagaacgtgattgggatgacttagctcgtttaattaccgaagaacatggtaaagttttctctgatgcacaaggtgaactaactcgtggtttagaagttgtggagtttgcttgtggcattccacatttagtaaaaggtgaattttctgaacaagccggtcgtgggattgatattcattcagccatgcaacctttaggagtttgtgtaggtatcacaccatttaattttcctgcgatggttccaatgtggatgtttccgattgcacttgcttgcggtaatacatttatcttaaaaccggcgaaagccgatccatctttatctattcgtttggctgaattattaaaagaggcggggttaccggatggtgtgtttaatgtagtgcatggtgatcgtcaagacaatgaaattttattgcgtgatcctcgagtgaaagctgtaagctttgtgggttcaactacggctgcggcacatgttcatgcgattggttcggcacatggtaaacgtgttcaagcactgggtgcggcgaaaaatcacggtttagtgatgcctgatgtagatattgaagcaacagctaacgcactattaggtgcggcattcggtgcagccggtgaacgctgtatggcattacctttagcagtaaccattgatgatgaaacggcagataaattagtcgcagcattaaaaccgaaagtagaggcattacgttatggtcccggtctcactaaagaaggcgaaaaagaaaatgattttggtccattaattactcgtcaacatcgtgataacgtaaaacgttatgtagatataggtgtgtcagagggggcaactttagtggttgatggacgtgataaattccctgttggttacgagaatggtttctttattggagggtgtttatttgaccatgtaactcctgatatgactatttacaaagaagaaatttttggtccagtattaggcattgtccgtgcgaaaaatttccaagaggctatgaaactaattaatgagcatcaattcggtaatggtgcagcaatctttaccaataatggtgcggcagctcgtgaatttgcatatcaagtacaagcaggtatggtgggcgtgaatgtgccaattccggtgccgatggcattccattgtttcgggggatggaaagaatccgcttacggtgcattaaatgcttacggtccagacggtgttcgtttttataccaaaatgaaaactgtaacaactcgttggccagagaaagatctttcatcacaagcagcattcagtatgccaaccctataagctagacaacagaataaaaatttaagttaatgtaaagaagatagttttttagctatcttcttttgcaagaaaaggaaatgaaaatgaaaaaagtccgagtcggtttaatcggaacaggttatattggtcgttgtcatgcgattgcttatgcacaagcaccgacagtttttcctcttgaggctgaattggttttggaatatttagctgaaatcacaccagaactggcacaacaaaaagcacaagaatttggttttaatcgttcgacaggtgactggcgagatgtagtatccgatccaaatatagatgttgttgatatttgtacacccaatttcttgcacaaagaaattgctttagccgctattgctaatggtaaacatgtttattctgaaaaacccttagcattaaccgcagttgatgcaaaaatcatgtatgaggcggcaaaaaaagcaggtgtcagaacccttgtgggatttaattatattaaaaatccgactacacaacttgctcgtgaaattattgagcgtggtgaaattggtgaagtaatccatttctatggtacgcataatgaagactatttagcatcagatacgacacccttagactggcattgtgttcgtgaaaaagcaggacttggtgcattaggtgatttggcagcacacattgtgcaaatgtcacaatatttagtaggtagcgatattgaaaaagtgatcggtgatatggagacggtagttaaagaacgcccaaatccccaaaatcttgcagagcgtttaccggtagaaaacgaagatcaagcaactgctatggtgcgttttgcaaacggttgtatgggaaccattgaaacgtctcgtattgcttgtggacgtaaaatgggattgacttatgtaattaccggaacaaaaggtacaattacctacacacaagaacgtatggcagagttaaaactctatcttcacgatgaagatcctgctcgtcaaggctttaaaacaattttgacaggtccgttacacgcagattataaaaatttctgtgtaagtgcgggtcatggtattggttttaatgatcaaaaaacggttgaaattcgtgatttagtgaatggaatagcgaataatcataatatgtatcctgactttgaagaaggttttaaagtttctcgtgtattagatgctattgcacaatcttgccaagaaagacgctgggttaacgtgaaagaaattgcgtaattttcaccgcacttttataagtatttaaaaaggtcgagttgaatgactcggcattttttaggtataaatttaaaatgttgtttatctctaatttttaaaaatttttccctcaaaaagtagatcttgttcacaaaattttaacttcatcattgctctgtatcttgataaatgttacatactgttttaaacaatttatttcaaattgttttatttttggaatttatatttcttcaagtggaatatagctgtatttcagaatagtgattaactcaactttccaggagtagcgttcttatgaagaaaacattattggctatgttatgtggcggtctattattaacctctcaagctgtaatcgcaaaaaattatgtcattggtgcacctatgaactcttttgcggataaatggcaaacttatcttcaagatgccgttcgtgattttgatgaaaaacatgatgatgtgcaaatcaaattggctgattcaaatagcgatcccaatattcaagtcaatttagttcagaattttatcgaccaaaatgttgatgcgttacttgtggttccaacggatccgacagtagtaaaacgtattggcgtgttagcaaaaaaagcgggcattcctttaatcgtggtgaaccgtaaaccaaatgatgagcatatgcaatatgtaaccagctttgttggttctgatgaaattgaaggggggcgaattcaaggtaattttattgtcaatactctagccggtaaaaatgcagagagtctcattttactcggaccattggggcaagatgcagtcactaaacgtactcaaggtaatgaggaaatttttgctcagcacaagaatattaaagtagtgagcaagcaagaaggtagatgggaacgtgaccgtggtttagctattgcagaaaacgtattggcggggaataaaggtattaacgttattgtgagtaacaatgatgaaatggctattggtgcaattcttgcaactcgtaagttaggtatcaaagacgaagacattactatcgttggtttagatgcaactcccgatgcgttagagtatttaggtaaaggtttggatgcgacagtattccaatccgcacaaggtcaaggttacaccggagctgaaatggcttatttagcggctaaaggtgaaaaagtaccaagcgttaaatgggttccttttgagctagttactccggataaaaaagaagaatatcaagcaagatataaatagacgcttcttaaccaacacaaagggtagtgtaatacctaccctttatcttgagcaaatgttgatcgttatcatctagagacaaagttatgttcaaaaaatcattgtttattttattgggagtagcgtcgttgttttcccccattgttacggcaaaaaatttaaccgttggcgtggcgatgtatagtctttcagataaatatcctacctatttgcaagatgctatgaagaaatttgatcaggagaaagcggatgttacttttcgttatgctgatgcaaattcagatccggcaagaatgttaagcgatattgaaacatttattgattctggtgtagatgctttgttagttatgccgacagatagcgatattattaaagctattggtgttaaggcaaaaaaggcaaaaattccgttagttgtggtgacaaataagcctaaagatgaggatatgaaatatatcaccagttacgtagggtcagaagagattactggtggtgaaatgcaggcaaactttattgtagaacaattaaaaggtaagccggcaaatgcgattattttaatgggacctctaggttgggatgctcaaattaaacgcactgaaggaaatgaaaatattctgagaaaacaccctgaaattcaggtgatcagtaaacaggaaggtaaatgggatagagcaaaagcaattgatattacagaaaatttgttatcaggtagtcaaaaaattgatgtagtgatcagtaataatgacgagatggcaatcggtgcactccttgccgcccgtaaaaaagggattgcagacgaggatatgttgattgttggattagatgcaacacctgatgcgttagagtatttaggtaaaggtttggatgcgacaatttatcaatctgcttccggtcaagggcgtaccagtgcagaaatagcgtataaagcggcaaaaggtgaaagtgtacctaagttgaactttattccttttgaattggttacaccggataaaaaagcacaatatattgataaatatagatgatagaaaacagtaaaaattaaccgctctttgttgttagaaattaccgttattaatacgacaataaaaataaggagttctaaatgaatgatttgagtcgttctccatatattttagagatgcggaatgtatctaaaacattccccggcgttaaagcattggacggcattaacttaaaagtcaagcgtggaaccattcatgccttaatgggggaaaacggtgcaggtaaatcaacgttaatgaaaattctctacggcatctatacgccggatgccggtggagaattaattttagatgataagccttttaaaccgagtgcaccgattgatgctattcgcactgggttgactatggtaccacaagaaatttctcctgcgggtaatttaactatcgcagataatttctatcttgggcgagaaattactcgtggtaaattctttttaaatcaaaaagaaatggattgtaaaacagcggaaatcttaaatgaattgggtattccgatggatgtaaccgctaaaatgtcagatgtttccgtagcgaaggcacaattggttgcgattgctaccgcagtttctaatgatgcgaaagtaattattatggacgaaccgacaacggcattaacagaagtagaggttgaacagctttataaaattattgaaacggtaagacaaagagggatttcaattatctttatttcacataaattagatgaagttttccgtgtttctgatgaaatcacagtaattcgtgatggtcaatatgtaggtacgaaactaacctcagaagtaaccaaagatgaattgatttctatgatggttggtcgtgatatgtcagaaatgttccaacgtgaacgtattgttatttctgatgaagttgtactcgaaattaaaaacttctctcgtgcaggcaaatatcatgatattaatttccaagtgcgtagaggagaaatctttggtattgccggtctagttggtgcaggtcgttctgagattgtagagggattgtttggttataaactggctgatagtggtgaaatctatgttcacggcgaaaaagccgatattaaaaccccgttagatgctatgaaatacaaaattggctttgtaacggaagatcgtaagttaacaggactgtttttaaatttaagtattactgacaatatgattatgcctagaatgtccccttacttggaaaattttttagtgtcggtgacaaaagcacagaagtcagcaaatgctcaaaaagataaattaaaaattaaagcaccaaatgttgaggtcattaccaataatttatctgggggtaatcagcaaaaagttttattggctcgttggttattacttgagccggatattttaattttagatgaaccaacaaaaggtattgatgttggggcaaaagctgagctttataaactcatggtggaattagcaaaacaaggtaagagtattatcatgattacatcagatatgcttgaattgctttcgatgagtgacagagtgatggtaatgcacgaaggtcgtgtagccggaattattccacaagaagaattgactcaagaacgggtgcttgaattagcatccggtttaggtcaagtataaaaagatttcccctagaataacaatcgaggtatttattatgtcaaatgctacgcttaaaaaaatattgaacgcctatggaatggtgtttattttaattgccttatttttagcattatctgcatcaattgatggtttcttttccgctcgtactgtttggagtattattgagcaagtttctatgtttgggatcattgcaattggagtaacctttgctattatcacaacggggattgatttgtcctctggttcaatggtagcgatgacttctgttgtggctgcttctatcgtaactggtggcgatacagtaagttcggcattacttgcttttgcgatttcaattgtattaggtgctgcaatgggggctatcaatggtagtttaaccgcttttggctctatccctccgtttattgctactttaggtatgatgattattgcccgtggtggtgctcaactttattcttcgggtcgtccaattgatgcctcttctgaagcatttacttggatttctgatgttgatttctttggattacccggtttagtacttgtttatatcgtaattgtcattgcttcacacattttactgagccgttcaacatttggccgtcacgtttatgcagttggtggtaatttaaacgcagcaaaaatttgtggtattaatacaactaaaacattgattttggtctatgttttcgccggtgccttgtctggactggtgggtgcattactggcagctcgtacttatgcaggtaacccctcttatggtttatcttgggagcttgatgcaattgccgcggcagtgatcggtggggtatcgctaagtggcggtattggtacaatccctatgtgcgttatcggtgctttaattattgggacaacaaacaaaggattaaatatgctgggagttgatccatattggcaacaaattattaaaggtttgattattgttgttgcggtattaatcgatacattaaaacgccgtagaaaagcaaattaagcaaaaggttacaagaaaaaaatagcaattgtatagttgctattttttttgtttgttggggaagtgcggttagaaaaatttgatcagctccacaaaaatgaaatttatttttcatttttattttatttgaaacgaaaatatgattatatagctacaaatttcaattatctgatttgggagatgatgatgaagacagtgagattaacggtagctcaagcattagtaaaatttcttgataaccaatatattgagttcgatggaaaggtaacaaaattcgttgaaggcattttcgggatttttggacatggtaacgtgctgggtttaggtcaagcactggaacaggatagtggcgaattgattgtgcgtcaaggacgtaacgagcagggcatggctcatgtagcaatagggtttgcgaagcaaaaattacgcaaacaaatctatgcctgtacttcatctgttggtccgggggctgcaaatatgattacagcagctgcaacagcaacggcaaatcgtattccacttcttttattacctggtgatgtttttgctactcgtcaaccagaccctgtgttgcaacaaattgaacaaacttatgatttaagtattagtaccaatgatgcttttcgtgcggtaagtaaatattgggatcgtgtaagtcgtcctgaacaattaatgacagcttgtatcaacgcaatgcgtgtattgactgatcctgcagaaaccggtgcggtgacaattgcattgccacaagatgttcagactgaagcttatgattttcctgagtattttttacaaaaacgtattcatcgcattgagcgtacgcctccaacggaagcgatgctacaagatgctttgaccttaattcaaaatgcgaaaaaaccactaattatttgtggtggtggagtgcggtactctgaggcggcagagcaattaaaagcctttgctgaaatttataatattccatttgcagagactcaagcgggtaaaagtgcggtagtttctgagcattatttgaatgttggcggtataggtgtaacaggttgtgtagctgcaaatttattagcaccggaggctgatttagtcattggtattggtacaagatatactgattttacgacgggatctaaatggattttcaataatgacgaagtgaaattcttaaatatcaacgttgctcgctttgatgcttataagttagatggtgtacaagttacagctgatgccaaagaaacgctagaaaaattaaccgcacttttagctacaacaggttatcaagcccaatggggtgataaagtggcacaggcaaaaaaagcgttggaaactgaattagagcgtgttcacaatataacttataccgaagattttgtacctgaaattgatgatcgtttaaatcgtgaggcggtttatgctgaatttatcggtatgactaaatcttgtttagcacaaacgagagtattaggtattttaaatgaaacattaggtgaaaatgatgtcatcgtgggggctgcgggtagtttaccaggagatttgcaacgtatttggcagtctaaaggcgaaaatacctatcacctcgaatatggttattcttgcatgggttatgaagtcaacgcggctttaggtgtcaaagttgcggagcctcatcgtgaggtttatgccttattaggtgatggatcttacatgatgttgcattctgaactggtaacgtcaattcaagaaaatagaaaaattaacgtaatattattcgataatatgacaaacggttgtatcaataacttacaaattggtcatggtatggacagttttgcaacggaatttcgttttagaaacaagaataccaataaattagatgggggctttgtaccggttaattttgctatgaatgccgcatcttacggttgcaaaacctatcaagtaactaccgaagaagagctacgattggctttggctgatgcaaaaaaacaacaggtttctactttaattgatattaaggttttaccaaaaacgatggcgaagggatatgacagctggtggcacgttggtgtggctgaggtgtcaaataaagctgaaattaatgctgcctatgaagattctgttgctcatattgaggtagcaagacgttactaatttaacttgataggctcaatattgagcccatttatcatgaaattcattcattctttttaagaaggacaacagtatgaaagctgaaaatgtaaaattgggcattgcaccgattggttggacaaatgacgatttaccggaaattggtaaagagaatacttttgaacagtgcgtaagtgaaatggcattagctgggttcaccggtagcgaagtgggaagtaaatatccacgtgatattgacgttttgaaacgtaaactggatttacggggtatccaaatttgtaacgcatggttcagtacattctttgttgatggtaaaaaagaagaaactatcaaaggttttatagagcatcgtgattttttacatgctatgggcgctaaggttattggttgctctgagcaaagtcgtagtattcaaggtcagaaaaaagcaattttcaaagagaaaactattttcacggaagctgaatggcaattgctagcggaaggttataatgagcttgcaaaattagccgcagaaaaaggcatgaaggtatgcttacatcaccatatgggaactggtattcaaacacccgcagaaattgataaatacatggaaatcactaatgatgatgtgtatttattattcgattcaggtcacctttattattcagaaggctcacaacaagttatgctggaggtattagaaaaatatattcaccgtgttgttcatgttcacctaaaagatgtgcgtgatgaggttgtggcggaagtaaaagcaaatgatcttagtttcttggaaggggttgttaaaggtacattcactgtgccgggagatggtgtaattgatttcaaaccgatttttgatattttagaaaaatatgattataaaggttggatggttgttgaagccgaacaagatccggcaattgcaaatccgttagaatatgcaattaaaggtcgtcaatatatcagagaagttgcaggagtttaaaatgattaaagtaggtattattggtgcaggtcgtattggtcgtgtacactcagaaagtattacaaaatatgtaaaatgtgctgaaatcaaagcgatttctgatgttcgtgttactgaagaattaaaagaatgggcaaagggaatgggtattccgaatgtctatgaagactataaattaattttacaagatgcggagattgatgctgttttagtctgttcttccactaatacgcatgcaccgatttctattgaagcggctcgtgcgggtaaacatattttctgtgaaaaaccaattgacgcagatgttgatcgtattcaacaagtattagcagaagtggaaaaagcgggtgttaaattccaagtcggttttaaccgccgttttgaccataatttcaaagcaattaagaatgcggtagtcaatggtgatattggtgaaccccacgttattcgagtcacttctcgtgatccagatgcaccgccaattgaatatgtaaaagtgtccggcggtatgttatttgatatgacaatccatgattttgatatggtgcgttatttgtccggcagtgaagtaacggaggtatatgcggcaggaggtgttcttgttgatccgaaaattggtgaagcgggcgatattgataccgcagttattaccttaaaacttgcaaacggggcaattgcagtgattgataatagccgtaaagcagtttatggttatgaccaacgtgcagaagtattcggttctaaaggtgcgatccaaaccgcaaatgatacgccgtcaacagcaattttatctaatgtgaatggtgtcatcgcagaaaaaccaaaatatttcttcttagaacgttacatgcaatcttttgctgatgaaatggcgtgctttgttgactcagtggtgaatgacaaaccaacattagtaaacggtactgacggtttgcaaccggtattaatcgcaattgcagcgaaaaaatcattggatgaagggcgtcctgttaaaatgagtgaaatttcctagtttaaggagattgcacgaaaaagggcggtaaaattaccgctcttttagcttgtacttctgttacgttgccaaatctccgaaacagacctgtaatgcggtgattgcactaagtgcggcagtttctgtgcgtagaacacgcttaccaagtaaaatttcagtaaatccctgagtttctgtttgactaatttcttgtgcagaaagtcctccttctggacctattaacaagcgaacaccttgtgggggaatttcaggtaaggtacgaattgtatatttagctcttgggtgaagattaagctttaaggttccgtcttgttcagcacaccaatcttgcaatttcattaatgggcgaatttcaggcactatattacgcccacattgttcacaagcggaaatcgcaattttttgccattgttggatttttttctccatacgatccttatcaagttttactccacaacgttcagaccataatggcgtaattatgttgacccctaactcaacggatttttgaatagtaaactccattctttctccacgagaaatcacttgacctagatgaataaataaaggactttcacgattgtccaattgacgagagagaatgttaacttcaattgcttttttatttgtttgagtaataatggcagggtaaatatggttacttccgtcaaataattcaatttgctcacctacctgcatgcgtagaacacgccctacatgatttgccgcattatcgcttaattgacaagtttgttgattttctaaagaggttggatgataaattcgaggaatacgcatattatttaatgggttagttaattttgttgctatgataacagaaattaaaagtgcggtgaaattcaccgcactttttgtcattgtatttgttgacttgaaaaaataagtaattttaccttatttttttatatcaaatttataagaaataaatccatatagcgtccaaccgatgaatgttacgattgaaccgtatagcatagcttgctcacctgctgcgtataaggcatataaactatataacgaaccgatgaaggcaacaaatgtggtaattttagctttatttaatgctactttttctactttaagtaagaccattaatgcagccattgataacagataaggtattacgttggtcaccaccgccaagtctaccaagatgttaaattgtttgtttaaagatggactgatagtcatcagtgctaataaactttgaattgcagtaattgtaaccataccaataataggtgcgtttttactggtcacttttttgaagaatgctgggaaatatccttcttcggctgaagatttgaatacttgagcaatggtaaactgccagcctaataatgaaccgaagcaggacattaccattaagcccattaccactttacctgttgtttcttcaaacatatgtgcaaaagctaaaccgaacggtgctgttgaattagcaagttccaaattaggaacaataccggcaattacgttggtggaaacaatataaataaccgccgcacctaatgttccgccaagaactgcgataggaacatttctttcaggattttctactacatcagtattcgcacaagctgactctaaacctaagaaggcccataacgtcatagaaatagatacgccgatggcttcaaaagtgggaacgttatgtgggttccaagcactgacatacatttcaccactaaaccagaaccaaccaattaaacaaatccctacgaccggaataattactccccagatagtaaaagagctgatgttaccagtgattcttgccccaccaaaattcaaaacagttgctaaccatagtgtgaatatagtgcatagtgcaatggatatcggtgataaagtgacatttaatagctctgatccgtatccaacggcggatattgcaatcgcagtattggcaatgactagagaaactccataagtgtagtttgccataaagttaccggctttaccgaaagaatattccgcataaccacccataccgcctgattttttactgaacataccacattgagcaaaagcataggctaaagcagttgaaccaacagctgtgactaaccaagatacaattgagatagttccaatttcagctaattttgtcggtagcatgataatgcctgaacccatcatatttaccattgtcagtatagtgagttgtactacaccgattttattacttttttgagtactcataattttatccctctattaaagtgcggttatttgtaattaaccgcacttatttttttattatgcttcagttaatacatatccataagcacgtgtacgtccatcaggatctttttgtagatatacgccctgaatttccggtgcgaatccaggaagaacattaatgccttcttccagtgcaaggaaatattgttgtactgtcgtactccaacgttcaccgggaacaacacataaaacacctggagggtaaggtaatgcaccttcggcggcgattcttcccacaatatctgtcaatggaactaattcaattttgttacgaacaaattcgatattcgctttttgtgggttcatagcatattccggtagagttgtttttctaaacaagtcacgttgtagctgtttaacatttctactgacgtaaagattgtgcatttcttgacataattgtctgatagtgtagccctgatagcgttcctcattatttttgtacacagtaggcagtacatctttgagtaatgaattttgtttgatatgtttttcaaacgcagctatttgagcaactaaagtttgcatttttgtcaatgtttcagccggtgtaagtaagaacaaaatggagttcaagtcacatttttcaggaatgattccattttctcgcaagaagttagcaaggattgttgctggaataccaaagtcttcatattcccctgtttcaatgttaatccccggagttgtgagcatgaatttacaagggtcaacaaaatattgattatctgtataaccctcaaatttatgccatgtatcatttgcatggaaattgaaaaactcaagatcatttgcaatttctttagtatcgtgatcttgccattttttacctttcacataaggaggaataaatggtttgattaaagtgcagtgcttaagcattaactttcttgcctcgataccaacttctacacactcggcccatagacgtttccctgcaggagaaccttgaatttgagcgtttacatccagagtggcgaatagaggatagaatgggctggtagacgcatgcaacataaaggcattattaaagcgtttgtgattgcaatatcttgcttgtcctttaatatgtttgtcttttttatgaatttgtgatgtttgtgagaaacctgcttgttgtttatgtaccgattgtgtcacgataataccagggtcattttcatttaaatctagtaataatggagagcaatctttcatcattggaatgaattgttcatagccgacccatgcagaatcgaacaagatgtaatcgcataaatgtccaatacgttcaacaacttgtttggcgttataaattgttccgtcataggtacccaattgaataattgcaagacggaaaggacgtttctcttcaagtttttccggtgccacttctgcgattaattttttaagatatgcttcttcaaaacagtggttatcaataccgccgatgaagccgaatggattacgggcagtttccaagtaaacaggggttgcacccgcttgaattaaagcaccgtggtgatttgatttgtgattgttgcggtcaaataatactagatcacccggtgcaagtagtgcgttacaaaccactttattggaggcggaagttccgtttagtacaaaatatgttttatctgcattatatacttttgccgcatgttgttgagcatcacatggagcaccctcatgtattagtaaatctcccaatttcacatcagcattacaaatatctgaacggaaaatattttctccatagaaatcgtatagataacggccggctggatgtttgcggaaatattgaccgccttggtgtcccggacaatcaaatgccaaattacccatttcgacatattcgcttaacattttaaagaatggaggtaacattttttgctcataaagagacgcagctgtttcaatttgacggctatacaaattgatatcatagctgtttagatcttgaacatgataaacctgatcaaaatattcatcagaaagtgtttcaccttcatttaatacgacaaaaataggaatattaaattcagtcgtttttatttgttgaatatacttaacatcttcggcagtcaatattattgcacctatatcggtgaaatcagtttgatttaataaaactaattcacgagttgatgtaaaatatttttgcactaatgggctatgtgcgatttttaattttaacataaaagactcctttgtcttatttaaagaatacaaatcaccctctcacaataaatatagaaatagtgagatagcttacttttaaagttttataaattattaatataaacagtacgtgaatttttatatttatttaactataaaaaacacgaacacttattctagaattaagaacaaacacaggtttttatttatcaagaaaaaccgtataaagaatataaaaattctaggacaaaatattaataaagtagaaaaccgtgaaatcccctttatttaaagggaattaaatggaaaagaattgatatggattacttttagaatggagaatagcaaaagaaaaacaagaacgatgggacggtttcataaggtgtcgagtacgacgaatatgtgccatcaaagaacgccccttaatagggttatattcttgactataattgtggtctaacataatagcctccgaaatttgttttgcttatatagttttagtttaccatcgaagcaaattttgcgcctataaaataaaaagtcaataaattttattttttttttttttttttttttttttttgacggaggtcacaaaaattaaattttgttactattttatgttatgaattattttccttttttgatccaatatttaaatggagtgttttctaaatcactttttaataaattatgatccataaattgacaaaagctaggaatatctctagttgtggcaggatcatctgcaagaattaataatatttctccttcttgcatatggcgaatttttttgcgtaagagcattattggttcgggacaacgtaatccaattgtgtttagagtttgtgttacaataatatcagtcataataatttctttgttagaatagaaagcgtgtatgatagcgtccaatttctttagggtcaaaataagtaaagtatgaaatatcttattccccaaagtgcggttgtttttgaagaagaaattaagaagagccgttttattacttatcttcagcatgcagaaggtttggagcaggctaaagcattttggcattcaataaaaaatcaacatccaaatgctcgtcatcattgttgggcaacggtttcgttacaacccggtaattcgcaaggattagggttttctgacgatggtgaacctagcggtacggcaggaaaacctatgttgaatgttttattgggaagtggtattggtgaaatttctgctgtagttgttcgttactatgggggaattttgctcggtacagggggattagtgcgagcttatggaaatggtgtgcaacaagctttgcaattgttacagacaagtttaaaaatagaacgaaaaatttatcaactttattgtgcgtatcatcaggtcaattggttacatgttttatttgaaaaatataatattaggatcatttctcaacattttttacaggatgttcaatttgagttgggtataagtgatgataaactggcagcatttcagaatgacttatctagttattcagcaggacagttaagattattagaaaacaaataagagagaaaattgtgcatattttatctattctgcgtatagtgggaattctagtaacctgcttttccattacaatgttaattccggcttttatagcgttgatttatggagatgggggtggaaaggcttttatcttgtcgtttttttacaatctttcagccggagttgggttatggtggctatgtcgagcacataaggcaagtttacgttcacgtgaaggatttttaatcgtcacaatgttttgggttttgctcagtttattggcagttattccttttatgttgttcgatgagctaacattgagccttgccgatgctgtatttgagtctttttcagccttaactacaacaggggctacagtaattttggggttggatcatttgccaaaatccatccttttctatcgtcaacttttgcaatggattggtggaatgggattgattgtattagtggttgcgattattccattgcttggtattggtagtggtcatttatatcgagcggaatcttcggggccaatgaaagatcaaaaagccttgcctcgtattggtgaagtggcaaaattattatggtttctctattgtatattgactattttctgtgcgtttgcttattgggttgcgggaatgagttggtttgatgcgatttctcatagtttttctacggtgtcaaatggcggaatgtccaattacgacgccagtttaggttactttgacaatccggctatttatttgattagtgctggttttatgctgattagtggttgtaattttgctttgcatattcgagcattaactaattggaaataccaacctgtctggaaaatttacgcaagagatcctgaatttaggtttttctgtgcaattcaagggatatttattttcttattatcgttagggttatatctgacctatgaaaattattctgtttttgatgctttctcacaaggtgcgttgcagtcagtatcaatggcaatgacttcaggttatactttatttgatttaaatcagcttccggcttttttggggatgttactggtctttatggcaatattaggaggatgtgcgggatctactacaggtggtttaaaaatgattagagtgcttgttgtatggttacaaatcaaaagagaatttaaacatttagttcaccctcatttggttattccaattaaattggggaaaatgttattggcacagagagttattgatgggatatggggatttttaattgcatttttcttaacctattgggtatgtgtatttgcggttatattatgtggaatgaatgctgctgatgcgatgttgtctgtctttgccacactaacaaatgttgggccaggtttgggaataattagccaaagtttttcacaagttccggataatgctaaatatgtattttcttttgctatggcagccggtcgtttagaaattttttctcttttacttttgtttacgccgactttttggaaatcataatgaaaacattgattttatatttaagccgagagggtcagactaaaaaaatcgcagaatatataggcacaaaatttgaaaaaagtgcggtacaatctttgcttgatttttctggtgatttagctaccttcgatcgtattattattggtgcctcggttcgctatggtcattttgatcaaagactttatcaatttttgcaaaaaaataccgcacttttacagcagaaagagagcagtttttttggtgtgaatttgacagctcgtaaagaaaataagaatacaccggaaacgaatgtttatgttaggaagtttttacaacgtattcggtggaaacccaaatatgtaggggtgtttgccggagcgttgttttatcctcgttattcttggtttgatcggatgatgattagattaataatgaaaataacagggggcgaaaccgatgtaagtaaagaaattgaatatacagattgggaaaaagtagacgattttgtactaaaaattagacaaggtgaatgaaaaatcagcttttgattatatatttgaatttttttgcaaagattgcttgcaaggaagtgataattttctataatacgcctcctcctcttttagaggggaatgagaaatgaatatcatagattatttggaaaaattttaagtaatcacttgacatgaggtttcaatctcactaaaattcgaagccttgcatttttggtgcagtgtaaattgttctttaacaaactatcagacaaactgtgtgggcacttgtgagactgtattgataagagattaaaagagtaagataagtgcttaaactagagaaattcatagagaaaagatggatgaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggactaaaggggtgggactgtgaggccacctgccatttgatgagcccaagtgggattaggtagttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagagttagtaagggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaagacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgatatgaccctgggtggagacactcagggttttttgttatttgggataaggcggggaagagagaagagrgaagaggaaactgggagaaaaaaagtaataaggtgataacaaggtagtcataaaaagtagggtaatgaagcagagtgaagaggtgcggtaggaaaattgtttttttttctaccgctctttttttaggtgatttatttttagcgatttgcttaatgcagaaaaacgatttgtgagagtttataaaaatgataacgaacaagtatttttacaaatgagcttagaatcaggtatgacagaagcatatttgatagaatctatcaagagattcatatcccttcaaactatgttttctgtgtttgtctcctttgggttgtaggtggtggacctggcggtgttgcattcggattgaaattggcatttggcgattatgtacactgcatttttgctgaaccgactcattcaccttgtatgctaacagcaagttatcgtcatgtgccagatgctgatttgcagggtgaatgggagatgactaaatttgtatttaataaaaaggaatttccgttagagccgaaaagcttgttttatgactggttatatttaaatgtgttgttttctgaacacaatacagcgttgagagaagatttttttcaaacgggttataacgcttttagtgatattgagtttaatcctgagaaatcgtttagttgtcaggcgcgtactttggcattgtgtgtatcgctttatgaaaataatgcgatataggcttttattcaggatcctgtgattttttcagcacaatattcattgtatcaaaaagtaaatcttgcacagcaatcagaacttttttaggagaaatttatgtttttatttcaaaatattgagcatattgagtatgtattcatataaactgatacattcgtcgctaagggtacaattatgtctgaaaatttctcaccactccaatctattgaacctgatctttatcgtttggcaaaagatgctggacatcacctacattcagatccacaatcttcactgatcaaattacgttgttttaccgagcaatttgtactattactctgtaagcagttgcatattgaattagttgataatgaaagcttatcagatcgtatgcgtaaagcagattttaaaacctatgttccaaaagagattcaacaaaaactccatttattgagaatagcaggaaataaggctgtacatacttctttctctcatctagatttttcagaagtggcagactgtttgcgtgaagcctatcttttaggaaaatggctctatcttaatcgcgttcctactacttgttaccctgattttatcctcccaagccctaatcacagcattgaacaattgcaacaacatattctttcattaaaagaagaaaataaaaaacttaatgaacatagccaaaaaataatagcagaaaatgcaaaactacatttatcatttacagaattaggagaaatacgccgagttcaagcggaaaaacttcaagaaaatacagagaaagtaaatttggagagtgacaaaacacttgcacgtttaaaaaaatacagactacgggattgttatagccaatttaaattaaccgatggacaaaaaacattagaggatcaattagatcagtttttagcagatccgaaacaacatatctttttattaaaaggttatgccggtacgggtaaaatctttattacccttggtttaaccgattatttagatcttattgaacgtagctattatttaagtgcacctactggaaaagccgctcgtgttatatccgaaaaaaccagaaaaggtgcatcgaccattcattctgccatatataacttggacaaattagtggaatatcaagatgaaaaagatccgaaaacgtataaattctataccgcattaaaagtaaatacagatatttctgattgtgtttatattatcgatgaaagttcaatggtaagtgatgtttatactgatggtgaatttatgcgttttggttcggggtgtctattaaaagatttaatggaatacattaatatcgatcaaaatgatcataataagaaaattatctttattggtgataatgcacagcttccgccgattggaatgaataattcaccggcgttggatagtaaatatttagctacaaagtaccgcttgaatagtctcgaatatgaattaacagaagtggttcgccaaaaatcggggagtggtattattcaaaatgcggtaaaaattcgagaatgtatcaataaaaaagagtttaatcgtttaaatatggatttaaattatcacgatattcatcaaatcgaggcgaaagacacgattcaaacttatttagagagttgtgggcataagataaatgacgaatcgatgattattgcttgtttaaatgccgatgtgcaaacttataatgaagcaatacgacaatacttttttccggataaatatgaaatttgtcgtggtgataaagtcatgtcattacgtaatcgtaaaattggtggggtgcgtattgccaatggggattttgctttagttagatgggtatcagatgaaacggaaacaaaaacagtgccattgaagaaaaaattagaaaatggcgaagtggagactaaggtaatagaactcaacttccgagatgttgagatcggttttagaaacactgatgggaaagcggtatttgttaaaactaaaattattgaaaatacgctttattccaaagatccacaattaagctcagatgaacataaagcattgtatatagattttagtatgcgaattagaaatgaaagagggattgaatatagaaaaaataaagaggaatttaaaaatgcgattttaagtgatccttattttaatgcactacctcttaaatttggttatgcgattacttgtcataaagcacagggtagcgaatggaataatgtcattgtgcaatgtaataacactcatcaaaatcaacatgctttaggttattctcgttggctttatactgcgattactcgtagttcgaaacaactctatttaattgatccgcctaaatttaatgcatgggataaattaaagaaaactactcctacttctatttcgccaattttactacaaccgcagctagaaaaaacggaagagaggcctaaaatgaaaaatgatcaaacaacagcaccattaaaaccggcattcaatgctgccgaattatcagcaatttctcagctcatttatcaaacagtatctactacaattaataatgcggatattattaacattgaaagcaaacaatatcacgatatttatactgtgttacaagatcaacataaaatccgttttaaagttgcttataatggaaaaaatcaaatcacccatattaactgtattgaaaatttacaagtagttccattattggaaagtcagttaaaaacattagaaggaaaaacattttttattgccgcacaagaaaaaaatgaaattacatttagctatgactttctcaatgaatttcatcagcaagtgatctttaattttctaagtaaaaataagataactatttgctcagtagatgaaaaacagtggaacattcgttatgaatttgccaataaatcggaaggaactgcgactttagatatttattttaatggtaaacatgaatttaccaatatcaaaccaatacagcctaaatcaacgtctaacgagtttttagaaactgtacatcgccttttaatgtcggagttgtgtaaatgttaacttttaccagtaaagaagtttttgcagaaagaaaaaatggcaatgccgagcaagcctataaaatggctaaacagctaatggcaaataatccaaatgacgaatggaatcaaagagctttagcttggtgtttagttgatctgataaaacattctactcaacaacatcaagaggcgatacattatattaatgaatttaagctaattgatgttgtaaaaaaagatgaattgttaacgaagcaattaaattactttgagaaataaaatgatccattgaacaatgaaattaacctcgctagagaagctagcaaatcgcgaaaatataaagaagctgccaatatttattttaagatattaaaacaacaaccggataacttagaaattcaaactagcttcgcgtggagtctttattttcttgctaaagaaacattaagccaatcatatataaaaactgaaaacataaaacgttatttttttgaatacttcaaacttaacattgaaaaaacatcaaaattacatcactgttttttatttcttgcattgaaattggttaagaatgaaaaattagccaaagaaaataatatcgatttttccgatttttgtttaaaatggaatttagataatctgaattgggaagattataaaatacaaaaaatagaaggaaatgaattttctccctttgctttagatatatttagaaatgcattaaaaagtgcaataaatcataataatcatcaaagtttagattatttggttcaatttattgagggtaaaaaaagccagcttcaaggggaaactatttggctggagtgggatttggctaaatcttatcattttttgaatcaggatatattagctaaaaataaagcatttgcattattgaaatcgaaacctaatgaatactggctatgggatttcttaggtgatatttatgctgtgtttgataaagaaacctcggctgcttgttatgctaaatccatcactttacaaaaagatattggttttatctataaaataaaattcaaactggtaaattattttattgcaaacggttattttgaagctgcaaaatgcgaaattaaagaaattattgattataaggaggcatagactcaaaaaactccggaagatattttatcattaacggaaagccaatggtatttatccactgaatgtgctactaataatcaaactttctatcaaaaactttccaaggaggcagaagtcttactttatagcaatcttccttggattgatgcatatttaggagatatttttgaaaataatgataagaaaatgtgtaaagtgtttatcaaatttaatgaaatcccaacggagatttcattacctgaaagcaaactatctttaaaatcagcaaaatcagggaaatatgctcaacttaaaggggaatttgagggaggtaaatttaagctttttctctgccgagagattgatgaaatacatcaacatcaaaaagatttctttactcggaaaatagcaattattgataatatcaatcatgagaaaaaagttgtgcatttcttagtgaatgaaaaaattggtacggtcgtttctataaaagaacttaattttaccccaaaagttgctgatgtagttgagattagcttatctcagcatactctcaaagatggagcaaaacgctacaaggtacatcatattgaaaaaatcgaaaaatcagcacctaatgatttactaaaatgctttgatgaacaaattcgggagaataatggcattgcctttacagaagagagcgatatatttattccaagtgatattgttaaaaattttgagttaagtgatggagattgggtttttggtatcgcaataaaaaattacaataaaaagaaaaaggaatggggatggaaagcggttaaaataacatctaaagagctttaagttgattttgatggagatattttattcatagattagatttttccaagacttatttaatcggcaacaaggtcatatatttatcaatatgaatatcggaaattttttaaatccaataattccactttttatgtcgtgcagagaattatcctaaggcgtagtttttcgtctatgtcttgctcgtgttttgttagctactccaaataaaatgaatgtcaatgggctgattatttgaggtatagatggcaaaaatgatgatactactactgaaagagctagactccccacggaattttagtagctcatcatgccaatgttggtagaccttagaatcaggattcgtcaaagcttgatgccaccctacacgttgtgcaatgaactgtcaaagtcctacatcaagtcagaacaggtaacaaatcgccccaactctaatggaacggctccacatggtacttctaaatagactttgatatgattcaacgcataatccaaaaaatcaaattcgggtaatttaaataaagttgccatatactgattcaacagcggttttcgttgaaatagagttgattttgataatattacttacttcatgccccgacaaaaagtcggggtattacgttttaaatcagcaaagttgctgcttttatgacagcttcaatagctttctgttcagtttgatgaatggtttgttcgtttggaatttcttgttgagtacggtttacgattacacctgataccatacctgcacgcagtcccaaagctgaacacattgtaaataatgttgcactttccatttcatagttcatgacattcaatgcttgccattgttttaatgaaccttgataatggcgacaaacttttccgctataggtatcgtaacgttcttgtcctggatagaaggtgtctgatgaggcggtaatgccgatatgaacactatctccaggttcatttgaaacagcatgatgtaaagcggacatgcaatcaaaatgggcaacagcaggatattctagtggagcaaaatgacggcttgcaccatcaagacgtactgctcctgtggtaataagaatatctcctacgttgatgtgcggttgaattgcacccgttgtaccgattctgaggaaagttcggatccccagttgtgctaattcttctaccgcaatagaaacggaaggaccaccaattccagttgagcaaacaacgacggctttttgacctatataacccaaccaagaagtaaattctcgagttgaagctaaaaatttcggattatccaatagacgagcaatacgttctaccctttcaggtgcacctggtacgatggctaactctgctccatccagtgaggcttttgttaagccaagatgaaagacatcagacataaaatattccttttgtttgttgtaatatctctcagtataaagcacctctgcaatttcatcaattctttcctgttggtataaaatatgggaaggtacaatatgagtgttaaggttggactctaatcttctataagattagaatattccttgaaatataattccacctgttggtagaaaaattgattttttcactgctctttttattagtatttatttttaaaatatcggtaaatgagtatatcatagagtatgtttttatatatttttcatattattttggactatggatataaaattacatttaaatgcaactacgacaccaaaaattcgagcttatttacaaaaatcagataaatcagatcttgagttagcagaacagttaggcatttcggttcaaacggtacgtcgttggagaaataggcaagatgttaatgatcgttctcatagaccgaaaaaaattaatagaactctttcttttgaacaggaatatttgatttgctacctacgaaaatatttcgctttatctttagatgaacttcttgaagctggaagaaatctaatcaatcaaagagtatctcgagcagttattagtcgttgtttaaaaaaatatggtctaaatattgctaataagaaagatttaccatctcaagttggttgtacttttttggcaatgtttcccctgcctaaagagatttctaaagaggaagattatctttttattctaatagagaaattgacaggatatatcagttgtgcttgcttggacagaaaactacagcgtcaacaaagtattatcaattactttaaatctagtttaccttatgaaattcaagaaattgagttagccgaagatattactcatcatgccatagtacaggcttttgccaaaaagactaaagtagttacgtctaccttaattttgcaaagtgcggtgaattttgaacaagattttatacggttagtatcaggttattacactgatagcagattaggatttgatgcacaactattaagatatgaagagtatctgaataagcatcttaaacgaaatcgcttaaaaaaactgtccccttatgattatcttatgaaatatcgccggtaggacagttagtttttttatttttttcgatatagctcaataaattctttgatgatgtccattaacaaaacagcattcattacatgatcttgtgcatgcaccataataatagtgacgggtagtttcccctcaccttcatcctgtccgatgagttctgtttgagcgtgatgtgctgctaacaaagcatcatccgcctgtttaagtaatctatctacttcctcaaactgctgttttttagcatgttgtagtgcttccattaaagcactacgacatattcccgcttgaagaattaaattcatcaattgcatttcaagttgctcactcatttttcctccaataaagatagtgcttgtgctaaaattttttctccatcggtcatgccataactcatcatatcaatacaagcgacaggtttgccgaattctgcaccaatagtttggcattcttgcagcttataggaaatttgaggacctaataggacacagtcaaaatcttgtattaatgaacgaaagctttgcatacccttagcttcaatttcaacgggtaaaccctgtgcttcagctgcttgtttcatacgtttaactactaagctggtggacatgcctaaatcacaaataagtaaaattcttttcattttttctccctattttgaaacattatttttcagaaattgataaagtagatgtaatggtttaccgcttgaatagattccttgatctctaaataaggttgtgccgctaatatctaaatgagcccaagtgcagtcattaacaaaccgactaaggaaatatcctgcggaaacacaaatcgccgcattatttggcggagtgttgcaataatctgcaatatggctttccacttggccgagaaatctatcatcacaaggtagttgccatatcgcctcttgtgtttgtattgcggctaaattaagttgatgtagaatttctgtattatttgtcatcacaccggaaatatcataaccaagtgcttttacaacagctcctgttaaagttgcaacatcaataattactgagggtttttgttcagctgcgaatgataataaatcagctaaaattaaccgcccttctgcgtctgtattaataatttcaatagtttttcctgaataagatcggacaatctctccggggcgcatcgctttttcatttatcatattttctgctacaccgacaataatacgtatgttaataggcaatgaattttctacaacggtttcaagtaagccaattaataaggcagcaccacacatatcatatttcatggttttcataccatcgcctgtttttaaccataatcctcctgtatcaaaagtgatacctttaccaacgaaacaataggtctgattacaatcaggggagccttggtaatcgacttgaattaaaaaagggggatgtaaaccgcttttacctacggcatataaagtgttcaaaccatggttttgtagctcttctgcatctaagcatcgtatggaaagttgagatttatgtgcataactgtttaatttttttgcaatatattcaggcgtcgcaatatcgctaggcagatctgaaatttttctagctgttatcatacccaatactattttgcatagttctaaataattattcgatagttgccgcttttgctccggtgtttccactataacaccaaattcaggcgatgcggcggtctctttaaaacctaaatattttggatggtaagaaaggttgagataactaataatcaattgttcattgatctgccgttctaattttacggtttcttttctccaatgtaataagattctttgtgcatctgagtgtgctattttttccatcaaaaaatgacgtattttccccattaagtgtgggttttcagccacttcttttttagaaaaaggtaagctatataagccggcattcgatatatttctgcctatctcgattttgctttccatgtccagtatagaaagcagaggtttcaagcagggttgttgctgtaaaaaatctcgatcttctttccaaaaaaacaacaaagcgttttttatctctaattgggtttgccaatcataaagcggaaattcaatgttcattttaactctccatgaatgcggtcaagataagcttgtagccaactttctgaggccggttcatattgtgtaattccattttctcgtttagccagataaatgatagggttatattgctctgttgatacgacaaaggaaaaattatcaatattagttgatacaccgaactctccttgcatattcatacatacaaccgacaaatctcctgctgttccgtaacgttctaataatcgtatttctaattcattgattgtcgtatcagcagcttgttgtggtgtcatcccctctttcatttttcgtacaatttcataactggtgcagcctttcattaagtcttcccccagacctgtagctgttgccgcacctatatgggaatcagcatagaatcctgaacctgagataggcgaatctccaactcgcccatgacgtttcataaataacccactggtagaggtacccacacaaatattattatttttatcaagtgcaataatgcccactgtatcatgcccggaatatggacttaatccacgaccgagagtctcttgatagcgtttttcataaaatgttttaacacggggcgttagcatatctttagcaggaaagcctttctttaatgcccatttttcagcaccgtgacctaccaaaaaactattaaaacgttcatgacttaatgcttcggcaacgagaattggattagcgatattacgcaagccggctacagctcccaatgccagagaagttccatccataaaggcagcgtccaattcgacatctccctcttcattgggtaacccgccataaccaacagatttatatagagggtaattttctacttgtgtaaccgcagttaaaattgcatctcttgcacttcctttgtttttaagtaattcaactgcctgacaaagtccttcaaatgccatacgccaagttgcaatcatcccccatcttgaattattcatttatacttgtccttctttcattcgatattgcttatcaataatacggaagaatggtaaataaatcattgcagcaatgaataagttgattacttgtataagtgcgccggaaatatgcccagttacaataaaaccacttaaaacaggcggtaatgtccaagggatataaactccggttgtcgtcgcaacaatatctaaatacattgcaacatactgtactgtagtaataactaaaggtgcaagattgaatgggataagcataattggatttaaaataacgggcagaccaaataagacaggttcgttgatgttaaataccgatgagccggcagctaaacgtgacacttttttagcatgttggctacgggcaaaaataagcattgctaagactaaggcgagagttgaacctgaacctcccataaagatcatatcaaagaattgttcggtaatcacatgaggaggggttaatccattttgcattgctgccaggttttcagcttgattatctaaccagaacggtcgtaagattccattaaccattgaacctgaattgattcctaccgaccataaaatatcgatcatgaatacggtcagtaatgcaccaatataagaagtaccaaaatggcgaattggtgtagccagcacggtatatacaaattcatgaatagtattatattcagttttcgagaataaaatccgaatgcctaatactaaaatcataatcaataaggcaggtatcagagctgagaatgattgttgtactgccggcggtacgccgtcaggcattttgatcacaatatttttgcgaatgagaaaggcgaataattcggtccaaatgattgccccaagcatagcaataaataaaccttttgaacctagccattgcgttgaaataactgaaccgacgttttcaactttaacaaaaggggtcaaaataaggaatgctgagagagataatataccggaggaaagtttatctatatttagacgttcaccgagtctataggcaaccagaaaagcaataaatatagacattgtagaaaaaacagcattaaagggaatttctatgatattatcccaaccctttccaaaggttgcggtcatgaaatctttatagctttgagatggaaatgaactaattaccagtaaaatagaaccaacaatgataaaaggcataaacgaaatataagcatctcgaattgctcctaaatgacgctgttgggctaatttaccggcagccaccatcaatttattttcaatttgtttaaacaaggacataataacctccagtaagtaagaaattacaaaacttattgtaggtgatttttgtttgaaaaaagttgataaagatcacaaaattaaaaaagtatcatatgattaattttattttaatgtaaatattattagaatatatttaattttttaaatgtttaatgatgtgatacatttttttaggtttgtatggatatagaaatatgtattgataatattgagtcagcattaattgcacaaaattcaggtgcggatcgtttagaagtatgtggatgtttagcgttaggaggggtaactcctccttatagcctgatcaaaacagtattggatgtgtgtaacattccctgttatgtaatgattcgtcctagatccggagattttttatttaatgcacatgaaataaaaatgatggagcaggacatccacattgcgaaacagttaggagctcaaggtgttgttattggagcattaaccgaaaacggtgaaattgatttatcaatttgccatcgtctaataagtgcggctgaaggtttgggggttacttttcatcgtgcgtttgatctttgtagcgatccttatcatggtttagaacagcttattgaattggggtgtgagcgagttttaacttcaggacagcaaaggacggcatttgaggggagatatgttttaaagaccttggtacaacaggcaaaaggacgaattaagattatggctggtgccggcgttaatccaaataatgccttggaattggtaaaaatcagtaaagttgatgaattacatttatcagccaaaacttttcgtcagagttcaatgaaaggtaattccagtgtgacgatgggaaataaagcagaagatgattacaaaatttggacaacagatcgaaatcaaattattgccataaagaaacttttccaagaatagaggggcataaattttatctggagagcggtgaaaaaaacaaaattttcaccgctcttttttcattattcaaccaactaattttgccgtgaaaatattactaataaccacaacatttttagagaaataaggtagaatacgcccctatttatttttataaagagctttgttttatttatgttatttgcaattggtcagcgttggataagtgaaagtgagaatagtcttggtttgggtattattacgggacaagataatcgtaccgttaccatttcttttcccgcctcggatgaaatgcgtatttatgctttagcaagtgcccctttaactcgagtattgtttcaaaaaggtgatgagattacacaccaattaggttggaaagcaaaagttgttgatgtcatgattcgcaatgagttggctttttatcttgtgcaacgacttgataataacgaagagattgctgtacaagaaatggaattagctcaccaaatttcttttagtaaaccgcaggatcgcttatttagtacacaaattgaccgcaatgagcattttgtattgcgttacaaggcactaaaacaccaacaagaacaatttcagtcctctttaagaggattaagaggaaatcgagccggtctgattcctcatcaattacatattgcacaagaggtagggcgacgtatcgcaccaagggtattattagccgatgaagtcggtttggggaaaacgattgaagcgggtatgattttacagcaacaattgcttgctgaaaaagttcagcgagtgctaattttggtgcctgaaactttacagcatcagtggcttgttgaaatgcttcgtcgttttaatttgcatttctctttatttgatgaagaacggtgtgctgattttgataatccggaagatcatgttgaagcaaatccttttgttgctgaaaacctaattatttgtgctttagattggcttgttcaacaaccgaaacgtgcaaaacaagccttggcgggtgagtttgatttattgattgttgatgaggctcatcatctcacttggtcggaagattcgccaagcatagcttatgaattggttatgcaattaagtgcggtgattcctgccgtattattattaacggcgacaccagagcaattggggcaacaaagtcattttgcccgtttgcatttattggatcctaatcgtttttatagttatcgggcttttgaaaaagaacagcaacaatatcaacctgttgctaaagcagtacaaagtctgttatcagagcatattttaacagttgaagaacaaaatcatttagcagaattacttagcgagcaagatatcgagccaatgctcaaagtgattaattctcaagctgatacggaacaaaagcaggttgctcgaggagaattaatgagtaatctaattgatcgtcatggaaccggtcgcttgttatttcgcaatacaagacaaggtgtgcaagggtttcctcatcgtatttatcatcaaatcaaattagatttaccaacacaatatcaaaatgcgattaatgtgttgaagatgttgggggaaataaaagatcctgagttattttatcctgagcaaattttccaaaaaatgaatgcggatgcaacttggtggcgttttgatcctagagtggattggttaattcatttagttaagagtttacgtgaagaaaaaatcttagtgatttgtcaagatgcgataacagccatacaattggagcaggcattgcgagagaaggaaggaattcgtagtgcggtatttcatgagaatatgtcgattattgaacgagatcgtgcctctgcatattttgcacagcaagaagagggtgcacaggtattactaagttcttcaatcggttcggaaggtcgaaattttcagtttgcttgtcatttagtgttattccatttgccgaataatcccgatttattggaacaatgtattgggcggttggatcgtataggtcaacgtcgagatattcaaatttatgtcccttgttttgctgatacaccgcaaattcgcttggctcaatggtaccatgaagggttgaatgcatttgaggaaacctgtccaatgggggctattttgcatgaaaagtgcggtgcaaaattgacagaatttttaacttcagacacaacggacgattttcagtcttttattcaacagactcatcagcaacaattacagctaaaatccgaattggagcaaggtcgagatcgtttattggaacttaattccaatggcggtatccaagcccaacaattagcaaatgacatcgcgatacaagacggttcaacagagctcattgatttcacattgaacttattcgatattattggtgttgagcaagaagatcttggcgaaaaatctattgtcattagcccgacaggaacgatgcttgtccctgattttccgggtttaaaagaagaaggggttactgttacttttgatcgtgatttagcgttggctcgtgaagatcttgagtttcttacttgggatcacccaattgtgcgtaatgggattgatttaatcgtcagtggtgatataggtaaaagtgcggtagctttattggtaaataaacaattacctaccggtacattgctacttgaattagtttatataattgagagccaatcaccacgtggattacagttgactcgctttttacctccaacaccgctacgtttacttcttgatattaaagggaatgatttaagtcatcaaatttcttttcagggcttgcaaaaacaactgaaaccaatgggtaaaaatatggcaacaaaagtcattaaaataatgcgtccagcgattgagcaattaattaagcaaagtgcaaaaaatgtagttgagccagctaaaatgataattgaacaagctaaacaactggcggatcaatcattgagtgcggaaataaatcgattatatgcgttgcaggcggtcaataaaaatattcgtccggaggaaattgaacagttagaaagtcagcgtacgttatctcttgaattgcttaatcaagcaaattggcgtttagacagtttacgggtaattgtgagtaataaggaataacatggcattaattgattatcgtccccctttagaaccttatttggacattgtatatcgtgatgatcatattctcgtggtgaataaaccgagcggcttgctttctgtatccggtaatcaaccgcaatattatgatagtgcaatgtcgagggtgaaagaaaaatatgggttttgtgagccggcacatcgtctagatatggcaacaagcggcgttttgctttttgcaatgagtaaaatggcagatcgagagctaaaacgccaatttcgtgagcgtgaacctaaaaaacattatcaagcactgatttggggacatttagcacaagataccggcacggtgaatttgccgttggtttgtgattgggaaaatcgcccaagacaaaaaatttgttttgttcatggaaaaagtgcggtaacaaattttgaggttttacaaagattcaaaaataatatcactcaagtcagattaacgcctattaccggaagatcacatcaattacgcttacatatgcttgcattaggacatccaattttaggcgataaattctatgcacccccacaagcaaaatcgcttgctccacgtttgtgtttgcatgcggaatttttacaaataactcacccgctgacaaaagaagtgatgcaatttagcacaccggcggattttccgatttgagttgctagcataaataatcagcccttaatctatatgattacgggctgtgtgtttataaggaactattgtctatttttataatactcaatagcttgtggcattaattttaataaattcgcttggcgagcatcatcggtggggtgagttgagatgagcttatccagcaaaccttttgaacccccggaggcttttttcattttttcccacaattgtggtgctgctttaggattgtagcctgattttgccatcaggaataagcctacttcatccgcctcttcttcggcactacgtgaataaggtttatttaagccccaatccgcagcaagtccgacaatcagtccacttgcgtcagtgccaatttttgttgataaagcaacatgagcaacctgtgcaaccacattagtgaacgtacccaaattcgcttttttcttaccatgttcttttaacgcatgtgccatttcatgccccattactgtagcaatttcatcatcagttaattttaagttgtcaactaatcccgtataaaacaccattttgcctcccggcatcgcccaagcattcatttcttttgatttgataacatttaattgccatgtaaaaacttgcccggtgttgttttctttatctgcataaggatgcatttttttaaaaattttatgtatacgttttgccgtcggtgagcttttatcaaccactccttttgcttcagcttgcccgattatctgcacataacttgaggcagactgttgattaattgaagatgaatctgcacaagcattgagcagtaacacagtaaatatgacaaaaataatttttttaatcgacataatgatatttaaactgttaataaaaaaccgccctttgagtaagagcggtttttagagattattttttagcacgttcgaatgattctaaaatttcttggcgagctgcttcaacgccttcccaaccttctactttaacccatttacctgcttccaatgctttatagctttcaaagaagtgctggatttgtgcttttaataaagccggtagatcatcaacatctttaatatgatcatattctttacttaattttgtgtgtggaacagctacaacttttgcatctccaccggcttcatctgtcatttttaatacaccaactggacgacaacggattacagaacccggttgtaacggatatggcgttggtactaatacatccacaggatcaccatcagaagaaagagtattatttacataaccatagttcgcaggatagaacatagcggtcgccataaaacgatcgacaaataatgccccactttctttatctacttcgtacttgattggatctgagtttgccggaatttcaatgacaacataaatatcatccggtaacgctttaccggcaggtacattttctaaacccatttttcttttccttttacatgttattgatgaatcaggttggggaattatagcgttatttctagggaattgtcgagttatcaacaaagaatcttcttactgaaaaaagtattgtaaaaaagttttgaactattataatagttcaaaatttaattttcaaaatgaggatctattatgacaaaaaaaatcccttctttatttggtggtgcaatgattattgccggaggaactatcggggcaggaatgttagccaatcctacttcaactgcgggtgtatggtttttaggttcaacattaatcttaatttatacttggttttgtatgacaacatcaggattgatgttacttgaggcaaatctacattatcctacgggtgccagttttgatactattgtcaaagatttattagggaaaggttggaatttgattaatggtgtgtctgtcgcatttgtgctttatattttaacctatgcttatatcacttcaggcggtgggattacgcaaggtttttttaatcaattgttaagtagtacagaaaatgcggtagatattgggcgtagttccggatcgcttatcttttgtattgtgctggcagggtttgtatggttttccactaaagctgttgatcgtttcagtgtggtattaattgcaggaatggtcatttcctttttcctctctataaccaatcttgtcggttcggtaaatacagaagtattgctaaatgctgtacaaggtgaacaacaatatttgccttatgcgttggtggcgttacctgtttgtttggtttcttttggctttcatcaaaatgttcccagtttggtgaaatattatgatcgcaatgcaagtcaggttttaaaagcgattttcataggtacaggcattgcattagtgatttatatcttgtggcagttggctattcagggaaatttaccaagagctgaatttataccagtcattgaaaagggcggtgatatttcagcattattagacgcattaagtaaatacttacaaacggattatatagcacttacactgaaattttttgcttatatggcaattgcaagttcattcttaggtgtaacgttagggttatttgattatatcgctgatttatttaaatttgatgatagtgttgctggacgcactaaaacagcgttaattacgtttttaccgccattattattgagcttacaatttccttacggctttgtattagccattggttatgctggtttagcagcaacaatttgggcggtaattgtaccggctttattagcgaaagctagtcgtaagaaattcaaaagtagcagttttaccgcttacggtggaaattttatgatatatttcgtcatcgcatttggtttattaaatatcttcgcacaacttgcaatgcagttcggttttttaccggagtttagaggctaaatagcttgaaaaagtaagaaaaataattatcttgttgacgtatgctttatttggcacccactgtagatacgtgggtgcttttctgtaaattttcctagtattagctttgatttgtttgctatagtaggcacaatttttagggagtattgtaggataaaaatggcagaaaaaatcattattgctgaacatcagtttatgcgtacgatttctcgtatttcccatgagattatcgaaaaacatcagtcgcttgatgatattgtgattgttggcattaaacgtcgaggtgctgaacttgctgagttaataaagcgaaaaattatagagttcagtggaattgaattgccctctattgatttagatatcacttcttaccgtgatgatttagagtatgtggatcaacagcaccagttgcctgtttatagtggagcatccaattatattaatatccagaataaaacggtgattttagttgatgatgtattgtttactggtcgtaccattcgagccgcacttgatgctttagttgattttggtcgagcggctaaagtggaattagtgatttttgtcgatcgtgggcatagagaattaccaattcgtgccgattacgtcgggaaaaatattcccacaagtcgtagtgagcaagttcaggttcgcacaatgcaatttgatgatcgttatgaagttgccttggtcacaaaataacatttgtgaaccttttgcaaaattgctactctaatgaacaaatttacaaacgtcttacggaatgaaaaagcggaataaaaaaatgaaagtatttaatttcaaagcagtgttgttttcaataattggtctacttagcattacgataacagcacaggcggctgaaagggtagtggctaccgttgatgggaatcctattttagaaagccaagtaaaaaaggtgttgggaaaacgagcaaataatgaggaaaatcgtcaaatagctttgaatagtattattgatgatttactagtacaaaaagctattcaagagttaggaatcaaggttgctccagcacatgtagatagtgttatcgaaaatattgccgcacaaaatggattaacctttggacagtttcttgatgttttagattatcagggcattaattatcaggcgtatcgtcaacagattgcctatcagattttaatatctgaagtgcgtaatcaagctattggcagtagcgtgaatgttactcgtgaagaaattcaagacttaggactaaaactatttaaacaagcgaaaaaacaaggaaaagagaaaaaagtaaccgcacctgaatataatgtacggcatattttgttaaaattgaatcctctgctgaatgatgcacaagccaaagcaaaattaactcaaattcgtgcagatattttggcgaataagataacctttgcggatgccgccttgaaatattctaaagattatctttccggtgcagatggtggaagtttaggttttatgttccctgaagcctatgttccagagtttgccaaggttatccgaacatctaaaaaaggtgtgatttcgacaccattcaaaacagagtttggttggcatattttagaagtaacggatattcgcaatgcggatataacgagagaagcttatatgcaagaagcatatcaacaaattgtgaatcaacaattgcaagaggcatcaggcgactggataaaggctttgcgtaaacgagcacatattcaatattttaattaattatgagatcccgacgcaaagtcgggatttttgttttataataccgccaattttttagcattcacactttcacttatgaagtcaaaaacacatttaggacatactgctcgtaaacgttttgggcaaaatttcttgcatgacaataatattattcaaaatattgtgatggcaatttatccacaaaaagaacaatttcttgttgagattggtcccggtttaggtgcgttgactgaaccggttgccgaaaaagtagagcgtttaacggttattgagttggatcgtgatcttgctgaacgtttacgccatcatccatttttacatcaaaaattaaatgtgattgaatatgatgcaatgcaatttaattttgaacagctttatattgatgaaaacttggctgagaaaaatcagaagttacgtgtatttggtaacttaccttacaatatttcaacacctttgatgtttcatcttttcaaatatcatgcaattattcaagatatgcactttatgctacaaaaagaggtcgttaaacgtctttgtgcagcaccaaacagtaaagcttatggtcgtttaactatcatggcacaatatttttgccaagtattaccggttttagaagttcctccgaccgcatttaaacctgcacctaaagtcgaatcggctgttgtgcgtttaataccacataaagaattaccttatccggtgaaagatttgtactggttaaatcgtctgactacacaagcctttaaccagcgtcgtaaaactttacgtaatgctttatcaaccttattttcggcggaaaaattaaccgcacttgcaattgatttagaggcacgagccgaaaatttatctattgctgattatgcaagattggcaaattatttagcggataatccgccaacagaagatctgcaatcggagtaaaaatccaagacaaaactgcaagagttaagataataatcaatgacaacattatggcaacttatttagtcggtgatttacaaggctgttatgacgaattacagcttttgttagagacggttcaatttaatcctgtacaagataaactttatcttgttggtgacttagtagcacgaggcgataaatccttagaatgtttgcgttttgtaaaatctttaggggcggcggcacaaatggtattgggcaatcacgatttgcatctgatttcaaccgcacttggtattaaaaaagtaagtttacaagaccatgtcgaagcgatttttacagcaccggattttgttgaattaattgattggttgcgacatcagcctttgcttgtccatgatgaaaaatgtgattttgtcatgagtcatgcgggcatttcgcctgactgggatttggataccgcaaaatcttgtgcaagagaagttgaaaatgaattacaacatggtgattaccattatttaatcagcaatatgtatgataaccaacctgatcgttggtctgccgatctgcaaggtttgcaacgtttacgttatagtatcaatgtatttactcgaatgcgtttttgctacagggatcatcgcttagatttcgcttgtaaagcgtcagtagaaaaagcaccgcaggaacttatcccttggtttaacttggataatccgttgtttaaagtacaaaatttggttttcggacattgggcaagtttagtggatacaccgacaccggcaaatatttatgcccttgatacaggttgtgtttggggtaaccgtatgacgatgttacggtgggaagataaacagtattttgttcaaggagcattgaaagattatttttagagtggcaacagtgcaatattatgtcgtgtgcaataatctgaataacagagaactgtagtgcggtgcggttcatataacaatatatgctaagtgtgcggttgtattgtgagtaacgatttttccttgtcgccgctcaagaatttccctgttcatttctccggttttaggctatcctatagcacattttctatatccaatttgcaccgcactttccattatgaataagtcttttagtaaggggtttagcggaaaaagtgcggtaatttttcatataaaaggtaatattatgcaagaacaatatcgtcctgatcttatcgaagcagacgtacagaaatattgggctgaaaagaaaacattcaaagccgttaaagatccttccaaagaaaaatattattgtctttccatgtttccttatccttccggtcgtttacacatggggcatgttcgtaactataccattggcgatgttatctcccgttatcaacgaatgaacggtaaaaatgttttacagcctatgggctgggatgcttttgggttgccagcagaaggtgcggcaattaaaaataaaaccgcaccggcaaaatggacttatgaaaatatcgaatacatgaaaaatcagcttaaagtgttgggcttcggatttgactgggatcgtgaaattaccacttgtaaacctgaatattataaatgggagcaatggttttttactgagttgtacaaaaaaggattggtttataaaaaaacctcaacagtaaactggtgtccgaatgatgaaaccgttttggcaaatgagcaagtacatgaggggtgttgttggcgttgcgatacccctgtggagcaaaaagaaattccgcaatggtttattaaaattacggactatgctgaacaattattaagtgatttagatcagcttcctgaatggccggatatggtaaaaactatgcaacgtaactggataggtcgctccgaaggggttgaaattacctttaacgttgctcattcagatcaaaccttaacagtttatacaacccgcccggatactttctatggtgtttcttatttagcggttgcggcggcacatccgttagctgaaagtgcggcaaaaaataatcctgaattggctgcttttattcacgaggcaaaaaataccaaagtggctgaagcggaacttgccacaatggagaaaaaaggcatggcaacaggattgtatgccgttcatccgatgacaggtaaacagttaccgatttgggtagcaaattttgtgttaatgcactacggtacaggtgcggttatggcagttcctgcacatgatcaacgtgattatgaatttgcacaaaaatatcaattgcctttattccccgtgattaagccggcggataattctgcatgggatttttcaaaacaggcttatactgagcatggtatcaccattaattctgctgagtttgacggtttggattttgaggaaacctttaacggtattgcggataaacttgaaaaaatcggtgtaggaaaacgccaagtaaactatcgtttacgtgactggggagtttcccgtcaacgttattggggagcaccaattccaatgctgacactggaaaatggtgatgttgtagttgccccattacaggacttaccaattgttttgccggaagatgtagtcatggacggagtaaaaagtccgattaaggcagatcctgaatgggcaaaaaccacttataacggacaagtagcattaaaagaaacggatacctttgatactttcatggaatcttcttggtactatgcacgctatacctctccacaatatcaacaagcgatgttagatgcagatgaagcgaattattggctaccggtggatcaatatattggtggcattgaacatgcaaccatgcacctattatatttccgtttctttcataaattgttgcgagatgccggtttcgtaacttctgatgagccaagcaaaaaattactgtgtcaaggtatggtacttgcagacgcattttattacaccagcccaaccaatgagcgtatttgggtatcgccgacaaaagtaacgttagagcgtgatgagaaggggcgtattatcaaagctgttgatgatgaaggtcacgagcttgttcacagcggtatgaccaaaatgtctaagtccaaaaataatggtattgatccgcaagaaatggtggagaaatacggtgcagatacagtccgtttatttatgatgtttgcttcaccggcagaaatgacactcgaatggcaagagtcaggagtagagggggcaaatcgtttcttacgccgcctatggaatttagtttttgaatacaatcaaaatccggcacaaaccgcattagatcctaccgctctttcagtcgaacaaaaagcattgcgtcgtgatgtacataaaactattgcaaaagtgagcgatgatattggtcgtcgccaaacattcaataccgcaattgcggcaatcatggaattaatgaataaactcaccaaagcatcattatccaatgagcaagatcgtgcagtaatggcagaagcattgaatgccgttgtgcgtatgctttatccgattacaccacatatttgtttccaactttggcaagacttaggtaacgaaagtgcgattgattttgcaccttgggtgatagccgatgctgaagctatggttgaagatgaaaaattggttgtgatacaagtgaatggtaaagttcgtgctaaagtaaccgttcctgctgatatgtcggaagatgaaattaaacaagttgctttagcagaagaaaatgtacaaaaattcttgaatggtttaactgtagttaagaccatttatgtaccgggtaaattatttagctttgtagcaaaataagaaaacataaccgcacgtgaaagtgcggttcaatttaggggagtttttatgttcaaaaaaattaaaatagcattactgggcattggcattttgcttattagtgcttgtgggtttcattttcaaaatggtgaactaattccaaatgaattaagaacattggtactggaaagcaacgaccctcacagtaatatgtcaattgccctacgtcgtcaattacaagctaacaatgtgagtatcgttgataatcaaaataatgtcactgttttgcgtctaaatagcacaaaaaatactgagcaggtagcctcagttttcaagcgaggttatgaagcagagaaaattttaacattagaagtatgggcaacagtgagtttaccgaataaacaaagctatctgatttttgctaatgtcaaccgcactttctttgataactctcgtgccgcattagcaaaatcagcagagaaggagattatttggaatgatatgcgtgaacaggcagcccgccaattaattggcaaaatgattgcattacaaacgcaacttcaaggtaaataatgaaccgcatcttttccgaacagctccaattatcactcaataaacggttgtccactgtgtattatttggttggacaagatcctttattgctgactgagagccgagatgcaattgtacagactgcgatattacaagggtttgatgaaaagttagaaattactgtagatcataccactaactggcgttctattttggaacaggctcaatctatggggttattctttaagcgtcaaatgctgattttaactttacctgaaaatccgaccgcacttatacagcggaatttacaagaactgataacgttacttcataccgatatcttactgattttacagatggcgaaacttactaagccaatggaaaaacaaacgtggtttgaattagcaggacaaaaagagcctcaagctgtgttagtgaattgccaaacaccgactgtcgaccaattgcctcgttggatcagtcagcgtgcatacagtatgaaattagagattgtgccggaggcgataaatctgctttgttatagctatgagaacaatttacttgctttaaagcaggttttacaattgctcgatttgctttatccggatcataaattgacctttaatcgagtgaattcggtcatagagcaatcttccgtatttactgtatttcaatggattgatacgttgttagagggaaaattagagcgggcagtgcgaattttacaagggttaaaagcagaagatgtacaaccgataattttgttacgtgctttacaacgagagctactcacgattttacaattgacccaaccacaacagcatatcgctaatattgacattccgctggtgaattcacaattaaaagaacggtttgatcgcttaaaagtatggcaaaatcgacgtcctttttttatccaagcgatacaacgtatgacttaccgaaagttgtatatgataattcagcaacttgctgatttagaaagaaaaaccaaggcggattttagtcatgatatttggaatgaattagataatttatctgcaaaaatttgctgtttttagttgaattcacaaagaatttaggtttattccatatctctactaacgatttttcttggattcatcattttttgtacaaaatatccgttataattcgtcaattaaaaaagttaatacataggaagaaaaatgatacgttttgaaaatgtgagtaaagcctatttgggcggtaatcctgctttgcaaggactcaattttcatttacctatagggagcatgacttacgttgtggggcattccggtgcagggaaaagtaccctattaaagttaattatgggcatggaacgagcaaatggcggtaaaatttggttcaatgggcataatattacacgtttatctaaatatgaaattccttttctacgccgtcaaattggcatggttcatcaggattatcgtttaatcacggagcataccattgctgaaaatgttgcacttcctttaattattagtggtattcatcctaaagaggctgaaactcgagcattggctgctttagatcgtgttggtttgcgtgagcgtgcgaaacattaccctgtttatttatcgggtggtgaacagcaacgagtggatattgctcgtgctattgtgcataaacctcaattattattagccgatgaaccgacgggaaatttagatatcaaattatcgttgggtatttttaatttatttgaagaacttaatcaattaggcatgacggtgttaattgctactcatgatttaacacttgtccagcagaaaccgaagccttgtttggttttggaaaatggttatttacgttaaggaaaggttatggctcatcgtcctatttatgcctcttggggcgtgcaggtacattatgtactgaaagcagtgttggcagggttaatcaagaaaaagtattcaactttaatgactattttagttattgcggtttcgttaaccattccaaccgttagctatttgttgtggaaaaatttatatcatgcaacgacaaaattttctcctaaaactgaattcacgctatttttgcataaaaatctatcggaaacagatgccaatattgttgtagagaaaatacgccagcaagagggcgtagaaagtttaaattatatttctcgaaaggaaagtttaaacgaatttcgtcatttttccggcttttctgaaggattggatattctggatgataacccgcttcctgctgttgtaatgattaaacttactcaagaatacaatgaaaatactaaacgccatcaactgcgtgaaaatctttttaagattaagggagtggatgatatacgtttagataatgaatggttagaaaaattgaccgcactttcttggctaatcgcacatattgcgatattttgtgccgtattgatggtatgttcagtatttttagtaattggaaatagtatccgatctgatgtatatagcagccaagcgaatattgaaattatgaaattactaggtgcaacagatcagtttattttacgtccttatctttacaccggcatgatttatgcaatattaggtgcgttatttgccagtatatttagtgccgcactcattggttattttacaagtgcggtcaactatgtcactgatatttttgcagtcagttttacgttgcaaggaattactatcattgagttattgtttttatttgtttgctgtacattaatgggctatttaagtgcttggctctcagcaagtcgttatatgaatttgttacataaaaatattagataaaaagcagaaaatttaaaattcttcgcttttttattaaaaaaacttgattttatcttaaatgttctgtaattaattgagatattctttttacaattcaacacaacattaactaataagggagattatatgaaaaatgtaggttttatcggttggcgtggtatggttggctctgtactcatggatcgcatggtacaagaaaatgactttacgaatattaatccagtattttttaccacttctcaggtaggacaaaaagcccctgtttttgcaggtacagatgcaggtgaattaaaaaatgcgtttgatattgcagagttacaaaaactcgacattatcgtcacttgtcaaggcggtgattataccaatgaagtttatccgaaattaaaagcaacaggttggaatggctattgggttgatgcggcatcggcattacgtatgaaagatgatgcgattattgtattagatccggtaaaccaacatgtgattagtgaaggcttacagaaagggatcaaaacctttgttggaggaaattgtactgttagcttaatgttgatggcaattggggggctgtttgaacgtgatttagtggaatgggtttctgttgcaacttatcaggctgcttccggagcaggtgcaaagaatatgcacgagttattagtacaaatgggacagctggaagatagtgtcaaggacgaattggcaaatcctgccacatcaattcttgatattgaacgtaaagttactgcaaaaatgcgtgcagaggacttctcaacaaccaattttggtgcagcattagcaggcagcttaattccttggattgataaattattaccggagacaggacaaactaaagaagaatggaaaggctatgcagaaaccaacaaaatcttaggactaagtaataatccaattccagttgacggtttatgtgtacgtatcggtgcattacgttgccacagtcaagctttcacgatcaaactgaaaaaagatttacctttagatgaaattgaacagattattgcaagtcacaatgaatgggtaaaagttatccctaatgataaagaagtaaccttgcgtgaattaacgccggcgaaagtaacaggcacattaagtattcctgtaggacgattacgcaaattagcaatgggacctgaatacttagcggcatttacagttggagatcaattattatggggggcagctgaaccggttcgccgtattttgaaacagctagtgctttaaatttaagagtgtagttaaatttattactcaagttgacactcgttattgtttgttatctgaattaaatacagtgataataaaataaataaagccctaattggggcttttttatattttaattattaatttgaacgcacttacatcaatgctttggtaggatttttttgctagaaataaaaaactattttttcatcaacaaatcacaactttttcttcatctgcatttgcatgttcgattttaccgattacccatgctttttcgcctacttgttgtaataatgccaatgcagtttccacatcttcctgtgggagagcgataatcatgcctacgccacagttaaaggttctatacatttcatagcgatcaatatttccttgttcttgtaaccatttgaaaataggatgccattcccaactcttttcattaattaccgctttaacggaagacggtaaaacacgcggaatattttcccaaaaaccgccgcctgttaaatggcaaatagcatgaacgtcagtatgtttaattaattgcaacaccggttttacataaatttttgtcggtgcaaggacttgttcagcgaatgaatgctcggctaattgtgctgttgtcggattaatacctgaaacttcaatgactttgcgaattaatgaatatccatttgaatgaggaccgcttgaagctaaggcaagtaatacatcgcctgctttaacgttggaaccgtcaataatttccgatttctcaactacacccacacaaaaacctgccaaatcataatcaccggtatgatacattcccggcatttctgcggtttcaccccctactaaagcacaaccggcttgcacacaaccatcagcaatacctttgatgacatctgctgcaacgtctacatccaatttacctgttgcataatagtcgagaaaaaataacggttctgcaccttgcaccacaagatcattgacacacattgcgaccaaatcaacaccaattgtgtcatgtttttttaggtcaatcgcaaggcgtaacttagtcccaacaccatcagttccggatacaagaataggatccttatatttacttggcaatgcacatagtgcaccgaagccccctaacccaccaataacctcgggtctagttgtacgttttacatcagatttaatacgttctactaatgtattccccgcattaatatccacacctgcgtctttataacttaatgattgtttactcacaattgaatcctaaaattagtatcgttattaaaataagcgatattgtaacacgctcaggcaatcgttttcgatgaattttgtaaagaaattttatcttttattcagcaaaagcgtgttgaaaaataaccgcacttttcctcgtctaaaaacgcagaaatgattatctaacgaattttcctgaaaatgatttaatccattagaaaatcatgcaaaatatctgcggtaaattctttccgcaaataaaatcctaaaggcaaagtatcgattatttcgccatttttaccgattcctttggttaacgctcgactatttgcccctttgggacggagttgcaggacctcaccaatacgggctgtaatttctgtgagcttacccagcacaatataatccatcaattcttcccaatcttgacgcagacgttgttcttgagaacttgatggctgccacaaaattggtacaccgacatggcgttcagcaagcggaatttgacgttcaccctcaataggaatccaaagcactttggataatttatatctgacatgagaagagtgccacgttacaccgctattttgggctaaaggtgccaaacttacaaaagtggtttccagaggataaccttgttgattaacaggaattgtttttagctcaatacctaaatggctaaaatcttgttccgctttgcttccggcagttgcacccagtgcggtttcaataagcattccgacccagcctttatctcgcttcaaatcgggaggcacaaccaaatttaactcttctgctaattcagcaaaggttaaacctgcaatagattttgcacgttgtaacagttcagcttcgtgttgagggggagtaagtgcggtcatgattgatgatatttttgtaataactttggtttcacgtattcaatgcctcgatcaatataatcaattttttccaattgcaataaatagcgttttgccggcaagcctccgccaaaaccggtaagttgcttttgttttcctaaaatacgatggcaaggaataataatgctaatcggattacgtcctacggcaccgcccactgctcttacggctttcggatgatcaatgaaacgtgccaattctccgtaactggcggaatgcccatatggaatttggcgtaaagcctgccatattttttgttgaaattccgtgccttgcggatgtaaaggaagatcggaaaaatcttccgcttccccgttaaaataacgatctaatgccgatgttacctgcaaaaagagcggtagattttgattaaaaatccaacgggaatttggctcaatttgttctaattcaaaatcaagatttgtcagctgattattttgcgacaacatcagcaatcgtccaattggcgaatgataataacaataaaaagtaggttgcataaaagaaaaaaggcgtattaacaaaatacgcctgattataacgaatagccgttagaaacggtagctaagatttaaaccgtacaaattggcacgtgctgttgattggtagtccgcacttannnnnnnnnnnnnnnnnnnnnnnnnnnnnnnnnnnnnnnnnnnnnnnnnnnnnnnnnnnnnnnnnnnnnnnnnnnnnttaaattgctgttttttaccacgtaaatgagcaaaacctacgtcaacagaaagatttggcgtgaaatgataggttgcccccaagctataccaagtgcggtcggtatcggggattgaagcactcggatgttcggcggattcatcataagcaatacctgcacgcagggttaatttatcattgacattataagtcgcccctagagctacacgtgaactgtcatcaaatttttcatctttatggaaagcgaccttaccgttatcataagtggcatgcaaactttgtaaacggctccattkagtatatttatagctgtagtgcatagcaaattttgctgttaattggtggaaaccggaaatttcgaaatagctcggtaaatgtaaagttaacttacctctatttcgataagcttcaatacttccagatccagcaagtatataacccaatgtatcattatctttaaaatcaatatctactttagaatggtaggcaataccgatacgattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccatttatattaattctagattgaacataaacccccccccattgagaattgtttcgttttaaacaaactcattaacgctgggttggttgccacaacagcggcattatcagcaatcgctgcctcacccgcataagctcgtcctaaaccggaactggacacctcggcgagttggaaagctgccgcattggcataagttgtggataatgctagtgctgacgcaataagcgttggcgtaaaaaagttttttgtgaatttcatttttttcataagcaatatagataatcttagttgttaaaagtccatcgaattctaaaacatggttatgacatgagcaaataagtttacgccattaggtaagaggtcagatcagttaaatagggtttatcttttttaacctgttacattttatgacaaaaagagcggtccaaattggcttggaagttggagcaaaattaaaatgatgttaaaatttcaccaattttttaattttaaatcaaggaaataacgatgtcagaaaatgtattgaaatgtactccggaggaaactaaggcttgttgttgtgcagatgtgggaacgattatagataattcggaactcagcgtagacttttctcaagtctatgaaaatgaaacaacagctcaagaggcattggcatatttaacggaaaaagccagaaaagcggaaacggaatcttgtgacattcgtagcgagattaaggaagtaaacggcaattatcagcttaatgcaacgtttacttttagctgtcaagcagaaacgctgatttttcaattatctataagatgattgaacaaatgaggaatcgaaaaaggatcatgttgcccgtagcacgagttaaggcaatatgtaacgatcaagaattgtaacttgttgagaacgtgttcagaataggaaaatgttcaaataatgaacaccccatattacgtcgaggaaaataaatgttttatattagaaaagccaatgaacgtggtcatgccaatcatggttggctagacagttaccatactttttcattcgccggctactatgatcctacatttatgggattttcatcattgcgggtcattaatgaagatcgagtcaaagcagggttcggttttggtacacacccacataaaaatatggaaattctttcttatgttttggagggaacgattgcacatcaagatagtatgggaaatgtgcaaacaatttcagcaggtgaatgtcaaattatgtctgcgggtacgggcataacgcattcagaatttaatccaagcagtacagaaaatttacatttttatcaaatttggattcagccgaatgagttaaatattgctccacgttatgaacaaaaagcgtttgctcatcacgaaggtgcaactttgattttgtcacctcatgcggaaaatggggcattcaaaatttatcaagatatgaaattatggcgttatcaattaagagcaggcactcaaactgatattacgttggatagtaaccgctcttattggatacaagttgttaaaggcactttctttatcaatggtcaaacagtttcaacaagtgatggtgtggcaattaaccaagaacgtttagcgaagattgagacggaaaatgatattgagtttttgatatttgatttggcttaaaaatttttgggattcaatgttgagcaaattcaatgttcaagcaaaataaaaatgcctgtctttgatatatttcaaaagcaggcatttccacaatgttcgagtaatgcttaaaaactcaccgcacttttcagttttttcaacgcatttgtttcaagctgacgtacacgttcagcagaaatgttatattttgctgcaagatcatgtagtgttgctttttcatcatctaaccagcgtgatttaataatatcttgactacgttcatccagttcagctaaggcgttggcaacctgatctgctgcttgtgtctcaaaattttcgttttctagctcagccgcaaaatttgagcttttatcttctaaatagagtgctggtgcgtaactttcatcatcatcaacgggtaaatcaaaaccgacgtcagatcctgtcattcgactttccatctcaaggacatcttctttggaaacgcccaattcatttgcaaccatatcaacttctttatcactgaaccaacctaagcgttgtttagttttacgtagattaaagaataatttacgttgtgctttagttgttgcgactttaacaatacgccaattacgtaatacatattcatggatttcagccttaatccaatgtactgcaaaagaaaccagacgaacaccaacttcaggattaaaacgtttcaccgctttcatcaagccgatattaccctcttgaataagatcggcttgcggtaaaccataaccggaatatccacgtgcgacatgaataacaaaacgtaaatgggacaaaatcaatgtttttgccgcatctaaatcttggtgatagtacaaacgttccgccaattccttttcttcttctgcagtcaacattgggtaatcataggctgcgtggatataaccttcgatactgccttgcggaactaacatcattgcttgtgtttctttattcattctattcctttttgtttataaaagacttattttctctatactttaagacttttaattgttttaatcaattaatatcttaaattctaatagttagaccataaatacattaaaaagttttcgtgttattttaaaattggcacaagaacatattctacattttgttcaattacttgcaataataaatcaatatttgggtgcttccctggattttctttggcatctaaaacatgttcggcaaatagttgcacgcctttttccgcacaagtgcggtctaatttatcgttaaatttttgagccaacgcattataaacacgcaaagaacctaattttccctgctcggcaggaatatgatgcacgacttgatcgtttgctaatatatctaaaccggacaagtgttcaatactgggtaagctcgttaaaattgtttggaaatccattttatttctccattattatgaaatataagcagtactatccacttcaccgttttccccaataaagcgtacttccggttgtaaatagacgttaaattttagtattaccgtttggtgaatatgctgtgctaatttaaccacatccgcactacttgcattatctttattaataatgacgagtgcttgttgctgatgaacagcggcaccgccgatttgatagcctttaagtccggcttggtcaattaaccaacctgccgctaacttaattgtgccgtccggctgtggaaaaaaaggtatagttgggtaatcttgttgtaaaagcgaaaatgcttgtgctgaaataatcggatttttaaaaaaactaccgctattaccaaactcatcgggattgggtaatttgctttggcgaatatgacaaatttcagcaaaaatttcttgtgcgttgacttgatgtgtatcgaattcagttaatgtgccgtattttaatactggttgccaattttttgctaattttagaccaactgcggtaataaaatacccttctctgtattgccttttaaaaatactttctcgataagcaaacgcacattcttcattgcttaaacgaaatattgtatttttttgtaaatccaatacgtccacataatcacaaacatctttaaattctacgccataagcaccgatattttgaatgggtgccgatcctgcacaacccggaatcaaagcgaggttttctaaaccataaatgccttgtgttaaggaccattgcactaaattatgccaattttctccgccattaacatgtaaataatgaaagtttgcatcttgcttatgtttaatccccataagctgattaataaatacaatgcctttaaaatcgtccacaaataaaacgttacttccttgtcccaaaaataagatcggcaaagcgttctttttcgctaatttccattgctcaattaactcggaaagtgcggtgatttttataattttttttgctttagacggaagatgaaatgtgtgaaagtcttgtaaattttccattaatattccttaaaatgtattcggtaaagttaatttcacttcggtaccgcctgtcgaatgattttgaatagacaagcgtgcatttaattggttactgcgttctaacataatatttaatccataatgcccggttggttcctttaaacttggaataccaatgccattatcacgcacagccaattcatattcaccgtcatcattagtataagccagcacttcaatttctgtgccttgtgaatgtttaatcgcatttaatgtcgcctctcgcacaatttgtaacgcatgaactagttgttgggcgttaaatgtttgtgaaggcaaagaacaatccactcgcattcgcattgaggtttgattgcgtaatgaatctatcacttgttctaaagcaacctgtaaatttgcctcttgtatggttaagcggaatgtggcgagaagttcacgcaactgtagataaccggcggtaactgcttgctcaaaatcttgaataatttcttggcttttggctttggcatcttgagtttcttgttgtagggtatgttttaataaagtgagttgaattttcaaataagacaatacttgagccaaagaatcatgtaattctcttgcaataattgaccgctcttccatgagtaataaatgctgttgttgtcgttgcatttggtaaaaatacagcgtgcgactgagcatttgcgagacattgtgcattgtgcgtaaatccggacaaggtaagcctgcttgccaacgcataatcccaagttgattattttcgatttctaaatccatactttgtaaatcaacggggtcttgttttgttcctaaagaaatatgccaatgctctgcaccatgaacaattaattctaaataccgcaaatgttcattaatcatcacttgttttagcatttgttgaaatagtttaggttcaatggcttttgtagtaacaagttgagaacaatgataaagcatggttaaagagcggttagcttgacttaacttttgtgttttctcattcactttttcctccaacgtggcataaagtttttttaactcggctgccatttgggtaaaaactaaagctaatcgaccaatttcatcatcacttttggtgtctaacggaatatggttaaattgtccaatttgaacttgagaacttgccaacgctaatttttccaatggggtaacaactcttttgcgtgtaaaataaatgacataggataccatagctaaaatcacaatcattgctactaaaatactgagtacggcgattttaagtttcagctccgcaaaatactgtaaagtatttacaaattgatctacttgatcgacatagctggcgatttctgcacggtaagcatccttgttgttttcttttgcatgcttttccatgatctcccaacgcttgattaaattacgataggattgccttacatcattaggtgcaagaaaatgccgactgattttgagtaatggctctgaatgcaaacttaaacgatattgacgtaatgccctctctacattgtccggttcatattccatttcataaaaaagtcggtaactttgcatacgtaatgagccggaaacattgattaactctgcatcagatttattactttgcataatagctaaactcattatgctaattaacgatacaaaaataatgatgagcaataaatagttggcaattttagttgaaacagaatgattttttatattcatataaacgtttttaagcaaaaatctcaccctatcatacaacagaatgtattgaataccgcatactttattattcatgccgatggcttatcatatactgactgtattcaactttaatatcatcggcaaattccctcaaaatacgccatcaattttgctataatactccccgcatattgagggcagaaacaatggtaaaaaatagcacaatcaatcaacatccggaacaacaaaccaaagacattattgacgaaaaactcatacaagcaggttggcttattcaaacagttaaagcttataatcctaatgcaggtttaggcattgccgtgcgtgaatatcccaccggcacaggacctgtggattatctgttgtttgtggatagagagcctgttgccattattgaagccaaacaagaaaatttcgcctacaaactcaacaccattgaagagcaaagtgcacgctatgccaaaagcgaactcaaaaacattgcccaagccgacatcgcttttttgtatgaaagcacgggtaccatcacacgctttactaattgcaatgaccccacgccaagagccagagaagtattcaactttcatcgccccgaaaccttacaaaaatgggcaactgaaggcaaaaacaccttgcgtgctaaattaaaagcactacctgtactcaatccgcaaaatttgcctgcttgtgagttaaacttgcgtgattgccaactgaccgccattgaaaatatacaaacttcgcttgctaaagatttgccacgtgccttaattcaaatggcaacaggtgcaggcaaaacttatactgcgattaacattatgtaccgtttgctcaaatacacaggcaaacggcggattttgtttttggtggacaccgtcaacttgggcgaacaagccgaacaagaaatgctggtttttactccgccggacgataaccgtaaattcaccgaactttacaacacccaagtcatcaaatcaccacatatccctaaaggtgtggaagtgtgcatttgcactattcagcgtatgtattctttattgaaaggcgaagatgtagctattcctgatgacagcgttgaattggaagaatgggaaaaccgtttaaaagaacctttatccgttgcctatcaacccaatttaccgcccgaattttttgattttatttttattgatgaatgccatcgatctatttacaacttatggcgacaagtgctggattattttgatgcctatttgatcggcttaaccgcaacacccgataaccgcacttttggttttttcaatcaaaatgtggtcagtgaatatagtcacgaacaggcggttgcagacggcgtcaatgtgggcaatgaagtgtttttgattaacactaaaatcagcatacaaggcggtaaattcaaagccgaggaactggtagaacaccgtgaacgtactacacgccgtaagcgttggcaacagcaggacacagacgaaagctacactgccaaacagcttgatcgtgatattgttaatcctagtcaaattcgcacaattatccgcactttccgtgatcatttgccaatcatatttcccaatcgtcaagaagtgccaaaaacgctgattttcgcccaaaacgacagtcatgctgatgacattatcaaaatggtgcgtgaagaatttgggcagggcaacgaattttgtaaaaaaatcacttacaaagctaaagacgatattttggacgaaaatggcgatattgtagagcaaggcgaggagccgaaaaccattcttgccaatttcagaaacagctatcacccacgcatagccgtgacggtggatatgattgccacaggcaccgatgtgcgtccgcttgaatgtttgctgtttatgcgtgatgtgaaaagtcgaaattattttgagcaaatgaaagggcgtggcacacgcacgcttgataaagacggtttgcaaaaagtcagtccgcccgcaccgtctgccaaaacccattatgtgattgttgatgcgattggtgtaaccaagtccttaaaaacctcaagtattcagttagacaccaagcgttccgtgagttttgccgaactgggcagagcggtggtgtttggcggagcgtttgatatggacagtattagctcattggcttgtcgtttgtctcgtttggacaaacaattaagccaagatgaacagcagcaaatcagtgaaattctaggcggtgttgccttatcacaagtggtcaaagacttgtttcacgccatcaatgccgatgaaattcacaagcatgcttgcgaacaagagggtatttcccttgatgaaacgccgtccgaagaaacgctattaaaagtgcaaaagcaacgtgttcgcaccgctactaaaacactttccatggagctgattaccgctcttgatgaaattcgcaaacagcacgaacaaaaaatcgaccacgaactggacgaagttacccatgtgggctgggcggaaaatgacgaagcgattacccaaaattttgcagattggataaatgaacataaggacggcattaccgccctgcaaattttttacaaccagccttatcaacgccaagcatttacccttgcaatgataaaagagttggcaaacgcaatcaaaaaagccaaacccaaactggcattcagccacatttggcaagcctacgcacgcctagaccaagtcagcgagcaaaaacaaaatgaactcactgcactagtcggtctcattcgtcgcgtggtgggtattgataacaaaatcacaccatttgctcatattgtgcgtaaaaatttccaaaaatggacatttgagcataatgcccgagcagacaaaaagctcaccgaagaacaaatggcgtggcttgcgatgataaaagaacatatcatcacttcattttcgataaaaagcgatgactttgaactcacaccgtttaatcagcacggtggattgggacaagcctatgatgtgctttgtggcattacccaaaatgacgattttgacgcattgcttgatgaaattaaccaacgatggacagcgtaaccgaaaacagggcaaaaataatgagcgatttaattatttaccaaaccgatgacggcaaaacccaagtcagcctattggttgaacaaggcgaagcgtggctcacccaaaatcagcttgccgaactttttgatacctctgtaccaaacataaccactcatattaaaaatatattacaagacaatgagttagatgaggattcagttattaaggattatttaataactgcgtcagacggcaaaaattaccaagtcaaacattattcattggcgatgattttggcaatcggttttcgggtgcgaagcccacgtggtgtacaatttcgcaaatgggtaaacagcacactgcaaacttatctagaaaaaggttttttgattgataaagaacggctgaaaaatccacaaggtcgccttgattattttgatgaattattagccgatattcgtgaaattcgtgccagcgaaatgcggttctatcaaaaagtgcgtgaactgttcagcctgtccagcgattatgacaaaacagacaaagccacgcagatgttctttgccgaaacacaaaacaaactgctctttgccgttacgcaccacaccgccgctgagctgattttaagccgagccgatgccgatttaccgaatatgggtttgactgcttggaaaggcaaagtggttcgcaaaggcgatgttgtgattgccaaaaattatctaacggcagacgaattggacagcctaaaccgtttggtaacaatttttcttgaaagtgccgaattgcgtgtcaaaaatcgccaagatttaaccttgtcattttggcggaacaatgtggataatttacttgaatttaacggatttgccattttggacaatcaaggcagtcgcaccaacgcccaagcccaaaccatagctcacgagcgatacgagcaatttcacgctaagcgacaagcccaaaaacttatcaatgcagacagtcaggactggcaagaattgcaaaccctagaaattgaacttaaaaaagcgaaataacccaacgatgagcaagcatacaatgaccgcaaacaacacattaccgcaagggtggaagaaatataatttatttgaaatttgtaaacccaaacaatggaaaactattgcagtaaaagatttaacagatacaggttaccctgtttatggtgcaaatggtgttattggctattaccataaatataatcacgaaaatgctactgttctactaacttgtcgtggagcaacttgtggtgaaattcacatttccaagccatattcatacataaatggcaatgcaatgtgcatggataatttatctgaaaaaataacaattgaatttctgtatttttatttaaaatcaattaatttaagttttattatttcaggttctgcacaaccacaaattacacaagttggactaaaaaaactagaaatcccggttcctccattgccaactcaacaagccatcgtcaataaaatagaaaccctatttgccgacattgatgcagggatagatagattgaaaacggcacaaaagcagttaaaacaataccgccaatccttgctcaaaaatgcctttaatggcgaactgactaaagattggcgtgaacaaaatgctgataatttgccgtcatcaagcgaattactcgcccaaattcaacaagcaagggaagctcaccacgccaaacagcttgccgattggcaaagtgcggttgaaaaatgggaacaaacaaggaaaattgggaaaaaaccgagtaaaccaaaagcccaaacacaagcggttcaatttgaagaaagtttggaagatttgccaagtgggtggggaacaatcaaaatcaatcaagtggctaatatttttacaggtgcgacaccattaaaaagtaatcctaattattatataaatggttcaattccttgggttacaagtggtagcttaaataatgcatttgtagaatgtgctgataattttgttacagatttggctttaaaagaaaccaatttaaaattattgccaaagcatactttacttattgcaatgtatggagaaggcaaaactcgtggaaaatgttctgaattattaattgaagcaacaaccaatcaagcgattgcaggaattgttctttatgaaaattttccaatcagcagacaatttttgaaattctatatgtttaaaaattatgcagatttacgccgacaatcatctggtggagttcaaccaaatttaaatttaagtttagtgggaaatattgtttttccttttccctgcttaaccgaacaaaccgaaattgtccgtattttggaaagcaaactttctgcctacgaccaacttgccaccacattaagcaaacaacttaaacaagccgaattgttaaaacaggcggtattgaaatcggcattttcggctagattggagattgatcaagggggcgataagcaatgttaaattggaatgatattgaacagatgctaatcagtggcaatctatgccaagaaaagctttatttggagtataaagaagcaaaaaacgatgtacccaaagcggtatgggaaagctactctgcatttgccaaccaatcgggggggctttattttgctcggggttgccgaaaaaccaaatctgcatatttccggcgtgggtaatcctataaaaattcaagatctcttgttctcacaatgctgaaatgtggaaaaagctagttgtgctttgctcaatagcgatgatgtccgacaatttgggatccaaggcaaaacggtgattgctgtttatgttcgcaaggcggaaacaacacaacgcccagtgcatctaaatcaagattatcgccgctcttttattcggttaaatacaggcgatcatcggctcaacgatagcgaattgcgttctttcttaatctagctatacccataaagattttgatgggcatattttaccctatggcacattggattatttgaatcgagaaaccttgaacaaatatcgccatttattaaaagcacataatccttcatcaccattattgattctttctgatgaacgctttgccaagaaggctgggattttttccattgatgccacaacaggcaagcaaggtattacctacgctgctttgctgttatttggcaaaggggaggctattaaaggtgtttttccgcattttttctttgagtatattgaaaaaagcgaagagaaccgccgttatgatctccgtattacggattttgatcttgaagatggcaacttatttgagttttacctaaaaattgaaccgagaattattgcactgggcaaggatactcatttcaaattagataaactcacacgcacggaagaaaatgaaattaccgaagcattgcgagaagccttggtcaatgccattgctcacgcagactatttcaataatgcacgccatctgaaaattgtgaaaacgaccaatcaaatcagctttgaaaatgcggggataatgttggtggaggttgagcaggcaattcttggaaaccgttccgaatgtcgcaatggcaaaattcacgacctcttacgacgtatcggcttatgcgaacggcaaggcgagggtgtgcgagatattttcgctcattggaaaagccgttatttcaacacgccaaaattagaaagccatattgatcacaccaagctcacactcacttttcaagatggtgaaattgcaaaatggcaggaaaaattgactgcttgcttgggaaaagattttctaaaacttaaagaaatcggcaaagattgcctgctttatattgccgtaaacggtcaacaagcaagccataaacacatgacagataaaatgcctcagtattcttctcgtgccattacccttgctttagcacagttaaaaaataaaggtttattaagtgtatcaggtgaaaaacgtagtgaccgtgtttatcatcttctagagctaattgcagataagtcaaaatgtgattatgtggataacagcctaaccgtacaagataaaactattgaaaatcaaatggttatagagaataactcgttgggttatatacaagataggatacaagataggatacaagataatcttgcttctttgttggaaattttaaatgatactgcgtacagtacgagtgaattattaacattgctggcgttaaaaagtcgtccaagctttgtcaaaaattatcttaataaagcattacaggcggagttaattgaaatgactattcctgacaagccaaccagccgtaaccaaagatatcgattaactcggacaggtaaacagcttttagcaaaattgaaaagagacacacaatgaccatacaaacacacacctcaaacgccattgtccaaaaagtttggagtttttgtcatatgctccgtgatgacggcgtgagctatggcgattatttggaacagattacctatttgattttcttaaaaatggcatttgaatacagccagccaccctataagagaaatgtcggcattcctactgaatacaactggcaaagtttgattaaccgttcggggatggaattggaaagtcattatttggcattattgcgtgatttaagctagaaaaaaggcttgcttgggcagattttcgccaaagcacaaaacaaaattcaagaccctgccaaactttctcgtttaattgcgatgatagacgaaaccaagtggacccgtttaaatactgatgtgaaaggcgatatttacgaaggtattttggaaaaaaatgctgaagacactaaatcgggagctgggcaatattttacaccacgagccttgattgcagcgattgtagaatgtgttcgtccgcaagccgatacgatcattgctgacccggcagcgggaacaggcggttttttattggcagcatacagttatttagaaaaacataccaatttaaacgctgaacagaaagtgcggttaaaaaaagggactttttttggcaatgaaattgttgccaatacccgctgtttgtgtttgatgaatttgtttttgcacggtattggcgaaatggacggtgaaagtccgattagctctgatgattctttgcttgcaccaagtagtcgaaaagcggatttggttttagctaatccgccctttggcaaaaaaagcagtatgacgtttaccaatgcggacggtgaagctgaaaacgaagattttgtttataaccgtcaggatttttgggcaacaactgccaataaacaggtcaattttttgcaacatatttacactatgcttaaaaacaatggtcgtgcggcggtagtggtgcctgataacgtgttatttgaaggcggtgcaggcgaaacggtgcgtaaaaaattgttgcagatgacggatttgcacactattttacgtttaccgacgggtattttttatgctcaaggtgtgaaagcaaatgtactgttttttgataatcgcccaactcaagaacaggcggttaccacagaaatttgggtatatgattaccgcactaatgtgcatcacactttaaagaaaagaccaatgcaattgactgatttacaagactttatcaattgctattgtgctgatgatcgccgtaaacgtacggaaacctatcacgccgataacaatcctgacggtcgctggcgtaaatttacccttgatgaaattaacaagcgggagaaaaccagtttagatattttttggttaaaagatcgttctttgaccgacttggatcatttgtcggaccctgatgtgttagccaatgaaatcatagaaaatatggaaatagctttgatgaattttagacgtgtagcacaggaattgatagataaatgaaatgagttgtcctcaaacaccgtttacagaaatgtaaacggttttttaaataaatcaatgatatatcatttttctcaagcatatccgcaattccacgcttcgtaacttcctatactgaaatcataaatttgatctacctcaacaaacttacattttgtcgagcaaatactcatttttggttattaaaaatcagcggtaaggtttggataataaaaatctataaaagaatagtgtggtttttaggcataacgttggtggaagaacagttatccagcaacgataacaacctcaaaataagaaagaatatgaaagaaaataaaaacgcaaaaaatcatgctgaggagtggcatgtttgtggcttaattattcaagtaaacccacaaaaaatagcacaagttaagaccgctcttttgacgattccgcatacggaaattccagcagaggatgaaaaaggaaaattggttgtggttatgcaatcggacgatccgcaggttttactgaatcatatggaaaattcacgcaatattgatggcgtgattgatttgtcgctgatttatcatcaacaagatgacaatgttgagcaataatttaaaaatgaatagtgggggagactatgaatttaagtcgtcgtgattttatgaaagcaaatgctgctttagctgccgcttcagtggctggcttaattattccggtaaaaaatgtaaatgcagctgacacaagtattacttgggataaagccgtatgtcgcttttgcggtacaggatgtgcggtattagtggggacaaaagatggacgtgttgttgcttcgcaaggtgatcctgatgcagaagttaatcgagggttaaactgtattaaaggttatttcctacccaaaattatgtatgggaaagaccgtttaacgcaccctatgctacgtatgaaaaacggtcaatatgacaaagaaggggaatttacccccgtaacttgggattttgcctttaaaacaatggcggaaaaatttaagtctgcattaaaagcaaaaggaccaaatggtgtaggtatgttcacttccggacaatccactatttttgaaggtgtggcaaaatcgaaattattcaaagcaggattactttcaaataatattgatccgaatgctcgtcactgcatggcatcggcagctgttgcctttgtacgtacctttggtatagatgaacccatgggctgttatgatgatattgagcatgccgatgctttcgtgctttggggttcaaatatggcggaaatgcacccgattttatggtctcgtatctcggatcgccggttggctaatcctgatacagttagtgtaaatgtcctttctacctttgagcaccgctcttttgaacttgccgatttaggtatccttctcaaacctcagtctgatttggctattttgaactatattgcaaattatctcattgaaaataatgcaattaatcgagagttcatcgaaaaacataccaaatttaaacgtggcgaaactgatattggttatggcttacgtccacaagatcctcgtgagcaaatagcgaaaaatgttaaaactgcgggcaagatgtatgatagttcttttgaggaattcaaaaaattagttgcaccgtacaccttagaaaaagcacatgaaatttccggagtaccgaaggagaaattagagaaactggcaaaactttatgccgatccaaataaaaaagttgtttcttattggacaatgggtataaaccaacacacacgtggtgtatgggcaaaccatttaatttataacattcatttattaaccggaaaaatttcattaccggggtgtggtcctttctcattaacaggtcaaccctctgcttgtggtactgcacgtgaggtgggtacttttattcatcggttaccggcggacttagtagttattaaaccggaacatcgtaaaattgcagaaaaaatttggaaactaccggaaggtttgatttcagataaattaggcttccacgctgttgcacaaagtcgtgcattaaaagacggcaaaatgcaggtgttatggcaaatgtgtaataacaatatgcaggcaggtccaaatatcaatgaggaaacttacccagggtggcgtaatccggataactttattgtcgtttcagatccctatccaaccgtatccgcactttcagccgatttgatcttaccaacagcaatgtgggttgaaaaagaaggggcttatggaaatgcggaacgtcgcactcaattctggcgtcaacaagtgaaagcaccgggtgaagcaaaatctgatttatggcaattagttgaattttctaaatattttacgactgatgaagtatggccggcagaaattttagcgaaaaatccggcataccaaggtaaaacactttatgaggtgctttatctcaatggacaagtaaatcaatactcaaatgatgaactgaaaggtcgcctaaatgatgaggcttaccattttggtttctatatacaaaaagggttatttgaagaatacgcaagttttggtcgaggacatggtcatgatttagctgattttgacacttaccataaagctcgaggcttgcgttggcctgtagttgacggtaaagaaactttatggcgttatcgtgagggttatgatccttatgtaaaagcaggggagggtgtttctttttatggtcaggcggataaaagagcggtgattttagcggttccatatgaaccgccggcagaggtgccggatagagaatatgatttatggttgaccacaggtcgcattcttgagcattggcatacaggctccatgacacgtcgtgtaccagaattacaccgttctttcccgaataaccttgtttggatgaatccgaatgatgcgaaaaaacgtggtttgaaacatggggataagattaaggttatttctcgccgaggtgaaataacgtcttatatagatactcgtggacgtaataaatgtcctgaaggtttgatttatacgactttctttgatgccggacagctggcaaataaactgatattagatgcaacagatccgatttcgaaagaaactgacttcaaaaaatgtgcagtaaaagtggtgaaagcgtaacaatcaacaaaaggcaccgcactttacttgctaaagtgcgatgaatattcatgaagaaaattgcttttacaccggaacgccgaaaatttttaagagataccgcccgaacctgtggcggacttgccggattaggcgtattacttggcttacaacaacatcaaagtctggctagacagggtgtggcattacgtccgcccggtgctttggctaatgaccaagattttacagcggcttgtattcgttgcggtcaatgtgtacaggcttgtccttataaaatgctgcatttagcctcattattatcttccatagaggctggaactccctattttattgcgagagagaaggcttgtgaaatgtgtgaggatattccttgtgttaaggcttgtccgagcggtgcattggataatcaacttgatgatattagtaaagcaacaatgggattagccgttttgcttgatcacgaaacctgtttaaactggcagggtttacgttgtgatgtttgttatcgtgtttgccctttaattgataaagcgattacgttggaaactcatcgcaatgagagaacaggaaagcatgctgtgtttattccaactgttcactccaatgcttgtacaggatgtggtaaatgtgaagaggcttgtgtattggaagaagccgctatcaaggttcttcctaatacattagcaaaaggtatgttgggagaacattatcgtttgggctggcaagagaaagataaagtagggcattctcttgcacccaaagacttaatatccttaccaattcgtcaaccggagagtaaataatggcaaattctcctaaacacagcggtaaagaattaagagaaaaattaggtttttggcgtgcaaaccggttcctcattttacgtcgggtaactcaattcagcattctcaccatgttcttgagcggaccttatttaaacttttggattctaaagggtaattatagtggtagtttattattcgacactatcccattaaccgatccgcttattgtcgcagaaagccttgcaacaggctatttaccgaacagttcaacgattattggaacaattattgttgtatcaatatatgctttacttggtagcaaagttttttgtggctgggtttgtcctcttaatgttgtaacggattgtgccgcttggttacgtcgaaaattagatattcgtcaaagtgccaaacttcctcgtggcttgcgttatggtattttgctgatgattttaatggggagtgcagtaagtggcgtattgttatgggaatggataaatcctgtttccgctttgggacgtgcgttaatttacggggttggtgcaacaacttggttgatatcggcagttttcttatttgacttatttattgtggagcatggctggtgcggtcatctttgtcctattggtgcaatttatggtgtgattggggcaaaaagtttattgcgtattaaagtagttgagcaacaaaaatgtgatcactgtatggattgttaccatatttgtccggagccgcaagttttacgtgcaccgctacacggtaaaaataatgaaagtcggtttgtactttcaaaagattgtatcagttgcggacgttgtattgatgtctgtgctgaaaaagtatttatatttagcaatagatttaatcattctgggagtgatcaaaaatgatgaaaaaaacactattatttattaccgcactttttgtgtcttctgcttttgcaacgcagaaagtaggaaaaaactaccaagatgctgttgaaaatgtgccagctgcatttcataaccatataaaagaaagtacaacgcccgcattaaactatgtaaatcaaccacctatgatcccgcatagcgttgcaaattatcaagtaacaaaaaatacaaaccagtgtttaaattgccatagtccggaaaactcgagaattaccggagcaacaagaattagtccaacgcattttacagatcgtgacggcaatgttaccggtcaaactgcaccacgacgctatttctgtttacattgccacgtatcgcaagcagatgttgctcctattgtgccaaatgaatttaagccaatgaaaggctatggtaactagatgaggatagatgtatggcaaatgaaaaatcaaatatcatcgttcgtttaagtaaaagcggttggaaatggtttaggaagccaagtcgtgctgtcagtgtattgattttattatcatttattgcaggtattattttttggggagggtttaacaccgcatttgaatacacgaatacggaagaattttgttccagttgtcatatgaatgatgttgtacctgaatatcgtcattctgttcactatatgaatcgcagtggagtaaaagccgactgtgccgactgccatttaccgcacgaatttattccgaaatggacacgtaaaatcggggcggcaaaagaagtttatgcgtatattacaggcaaggtagataccaaagagaaatttgaggcacatcgcttagaaatggcacaacgtgaatgggctagaatgaaagccaatgactcacaagaatgtcgtcattgccataatttcaatgatatggatactactcagcaaaaaaatgtcgcacaaaaaatgcacagaatggcacaagaacaaggaaaaacctgtattgattgtcataaaggtattgctcaccaattaccgaatatgaaagacgtgcaatccggttttttacctgagcaatagtgaaaaaattgaccgcacgttgagttgcacctccaacgttggatacatccgactgattgaggtgcaacattgtgactatttgattttaaattatttatcctaatgcaactctcgcattttggaataaacgcatccaagccccgtcttcttgccaattttcaggataccaagaattgtttactgctctaaatacacgctcagggtgtggcatcataatagcgactcgtccgttggaattagaaagtgcggtaattccctccacagatccgttcggatttgccggatacatttctgtcggatttaactgactatcgatatattgtgcagcaatcaaattctgtgcttttaatgcttgcaactgctgatcatgcttaaattcaattcgtccttcaccatgagaaaccgcaatcggcatatgtgatcccgacattccgttaaaccatacggaatgagtatcgttaatgcgaaccattgcaacacgagcttcaaaacgttctgatttatttcgtacaaatcgtccccagttttccgtaccgggtataatttctgctaaattggataacatttgacaaccgttacaaacacctaaggctaatgtgtcctgacgatggaaaaatgcactgaattgatcacgaagtgcagtgttaaacagaatagatttagcccaaccgccaccggctcccaagacatcgccataagaaaatccaccgcaagcaacgagtgcgttgaaatcctgaagatgatgacgtcctttttgcaaatcactcatatgaacatcaatggcattaaatccggcacgatcaaaagctgccgccatttcataatggctgtttaccccttgttcacgcaaaatagcaatacgaggttttgttcctttttggatataaggtgcggtgattttttcatttagatcataggtcaaataagcggaaagtcctttatcattcggatcttttttcatctcaaattcttgatcggcacaatccggattatcacgtaaacgttgcatttgatgtgttaattcagcccaaatcccacgtaatacggaacgtttttcactcaataagactctggtactgcgagtaatctcgatatgatcatctgcggtaacaataccgagttctttggttaaatgaattaatccatgttcggtcaatacggcacgcaccgctttaaggtcactttctttgacttgaattacggcacctaattcttcattgaataaaacaccgagatcattgtcacccaatgcactgatgtctatggaaataccgcaatgaccggcaaaagccatttccgcaagcgtaacaatcaaaccaccgtccgaacgatcatgataggccagcaatttctcttgtttcacaagagcttgcattgcatcaaaaaagcctttcagcaaagacacatttaccacatctgccggtacatcgcccaattgcttatacacttgagcaagtgcggttgcacctaaacgattttttccctcacctaaatcaattaatagcaatcggctatctcctttgtccagacgtaattgaggtgtaaccgtcttacgcacatcttctacacgagcaaacgcactgataattacggaaagcggtgcggttacggatttttgatatccttcttcctgccaagtggttttcatagacatggaatcttttccaaccggaatggttaaacctaattgagggcataattcctcaccgattgcttttacagcctcataaagtccggcatcttcgccgccatgacctgcggcagccatccagttagcggataatttaatccgtctaatatcgccgatatccgttgcggcaatattggtaatgctttctgcgacagctaaacgtgcagaggcggcaaaatccaacaaggcaacaggagttcgttctccgatagacattgcttcaccgtgataactgtctaaacttgctgttgttaccgcacaatccgccacaggtacttgccacggaccgaccatttgatcccgtgctaccatacctgttactgagcggtcgccgatagtgattaaaaatgttttctctgctacggcaggtaaccgcaataccctgaacaatgcttctttaatttggatcatagactgatccaattggggattattgacttttgcggatttcacattacgtatcattttaggggttttacctaacaagatgttcattggtaaatcaataggattgttattaaaatggctatcttgcaaagttaactgctgttgttccgttgcctcaccaatcaccgcaaaagatgctcgctcacgctgacaaatcgcttcaaagagcggtaatttttctggtgaaacggctaaaacataacgttcttgtgattcattgcaccaaatttctaacggcgacattcctttttcatcgcataaaatttttcgcaactcgaatcgaccacctcgaccaccatcatgaactaattcaggcatcgcattagataacccgccggcaccgacatcatgaataaaaagaatggggttttctgaacctaattgccaacaacggtctattacttcctgacagcgacgctccatttccggattatcccgttgtacagaagcaaaatccaaatcttcttttgactttcctgatgccatagacgaggctgcaccaccgcccagaccaatattcattgctgctccgcctaacacaattaatttcgcaccaacaggaatttcgcctttttgcacatgttcatgacgaatattacctatcccgcctgccagcataatcggcttatgatagccccgcacttcttcgccgttaaaactgttgactttttcttcataagtacggaaataacccaataaagcaggacgcccgaattcattattgaaagcagcaccgccaagcggaccttcaatcataatatccagtgcggaggcaatacggctcggtttactcaacgcattttcccaaggttgcggaaaattcggaatacaaagattagacacggagaaaccgactaaaccggctttcggttttgcaccacgtcccgtggctccctcatcacgaatttcgccacctgaaccagttgcagctccggggaaaggtgaaatggcggtagggtgattatgggtttccactttcatcaaaatatgcgtgtcttcttgatgataacgatattgcccgtcttggttagggaaaaagcgtccgacttttgaaccttccatcaccgcagcattatctttataagctgacaatacataatcaggcgttttctcaaaggtgtttttaatcattttaaacagcgatttatcctgtttttttccatcaataatccaatctgcattaaaaatcttatgacgacaatgttctgagttcgcttgtgcaaacatataaagttcaacatctgtaggattgcgaccgagtgcggtgaaattttccactaaataatcaatttcatcttttgctaatgccaatcctaaagtcacattcgccttttccaatgcaacatgcccaccggttaaaatatctaccgtggtgaaaggttttgggtcatgctgttcaaataaaacagctgcttcttgtggagaacggacaatactttccatcatagggtcgtagatacggaatactaattgttgttcttcttcagccgttaaagtgcggttaaatttgaaataataagcgataccacgttccaaacgaagtaccttatttaaatcacaattatgtgcaatatcagttgcttttgatgcccaagaagaaatcgtacctatacgtggaatcaccacaaaacattccccataaggctcttgcgatttctgagtcggaccataacgcaaaagctcctctaatttttctctttctacctcagttaatgcttcacttaaatgggcaaaatgcaaaaattctgcataacaagacacaatgggtaaattatcttgctgaaaaccactgaataactgatttaaacgaaaattggataatgcgggcgtgccacgaaaaatgtgtaacatagaaaagatccatcaaaaaaataaaaaacgaccacattataaaggaatttttatcggaacgaaaacgtttgcctaatgcaattttcaaaaaatagttaataaaaagctgataactgaaatgatctgcaccccaaaagttggactaaacaactaactgatgaagtgcagatttttttaggattaattttttggtaaatatctcattggatctactgattgacctttataacgaatttcaaaatggagtttgattgtgtttgttccagaacttcccattttagcaatttgttgacccgctttaacttcttgctgatctttgacgagtatactttcattatgtgcataagcacttaaataactgtcattatgtttaataataattaaattaccatatccacgtaaagcgtctccggcatatacaactcgtccagcagctgctgcattaacagcttgtccacgagaaccgctaatatcaatacctttattgcctccatcagcactggaaaatccttgaataatttttccatttgttggccaaatccaagctatatttgaggtggctggaggtgttttattgattggcattgttgaatgtgttggtgtagcaacgggtttcatttgttcatttgttggtttattagcattccatgtctcattgactgtattttgtgtcacctctgattcatttattgtctgtgttggtatcatattgctatcgggaatattatttgcaattttcaatacttgtccaatactcagatgatatggctcagacatattatttagtgtggccaattcttttatatccatgcctgaaatataagcaataagaaacatggtatcgcctttgcgtactttgtaagtatcacctttgtaaaaacccttatcaattttgctataaacaggcacattagttttaggatctcttggaatttcaaaattttgtagagcctgtttttttgctatcgattctgttttttgttgattttgttgaatgatttcaggttgataagtggagtttgttgctttcggcactctcatactttcgggcatcttttgttgaataacttgaggttcccaagcggttgagtttgtaccattaatcggtttgataatacttggtgctaaatccttagcattttctaccggagccggagtgtgtgaactacaagcagctagtacagtgatactaatagataaaggtaaaaattttttcatgtaaattctccgttactttatattcattttttatcttagattatttcaagacaagatatacaactatagcaataatgacaactgaccaaccgataaattcaatagattgacgtaatttcgcagcaaatttttttccgctccaagccgctaaatgggtaacgagcaaaaatcttgcaatacgagaaataaaggcagtaagtaagaaaggcaaaaatgccatttgcatgacgcctgcacaaatcgtaaaaattttataaggaataggtgaaaaacctgcaacgaaaactacccaaataccccattctttgaaccaagaaagagcagtttcccaatgttgttgataaccccattgttgaatataactttgtatgaaatcaaaagcgtaataacctaatccataaccaattgccccaccaatggctgaagccattgctgcataaaatgcaaatttagtagcacatttaggtttatttattgacatcggaataagcatgacatcaggtggtattgggaagaaaatagcctcaataaaactaacaaaagttagccaaaatgtagcaaaacggtgatttgcccattgcatagttttatcatatagcgtaccgaaaattttcatgttttattccttcgatgaaaagattatcgttattccttatctaaccattgttgtaaagctgtcattgaatgatatgccgtcatatctgtttgaatgggtgtaattgacacatagccgtttttaacggcatggaagtccgttccttccgattcattttctgccagtcctattggtccaatccaataaatctcttcacctcttggatctttttgtttaataatatccgctgcagctgcacgatacccaagatgacaaactttaataccttttatttctgaataggggagatccggcacattaatattaataatttctcggctttttaataatcgtccatatagtttaggaataagttgactcacaattattgccgcactttcataatgttgtcgtccatctaaagaaactgcgattgcaggtaagcttaaatggcgaccttccagtgcagctgcaacagttcccgaataaataacgtcatcacctaaattgactcctgcattaatacctgaaacgacaaggtcgatctgaccggataaaaaaccgttgagtgctaaatgtacacaatctgcgggagtgccattgatactataatcaccattatccaatttcattggtcgtaaaggctcaacgagtgtgagtgagcttgaagcggcactacgattacggtctggtgcaacaacagtgacttgtgcaaatttacgtaattctttagcaagagttttgattccctctgcctgtatgccatcatcattagaaagcagaatatgcatattatttcctatgttttaaattattattcattaatattaaccagttctcttactaaggctgtcgcataacttcctgccggtaaataaaaagtcagttttaatccctcaggtataaatgaccagcttaagtgttgagcttgcataagtattggacgacgtgccgatttcattttttcctggtgcattaagtacaggagttcttgatgtttagcgataatttcattttctacatcactggcaatttgtacattttcaccaattaatggtgcagtgatttgaatatcctgttgtgctaaacgttgttgtaataaattaaaatcttctttttgatcagcatggaaccaactgtgtgagccggataactgcaaaatatcatttactaagattttatggtgtagaccttgtcgaatacgagcggatacaatcaagttaaaaatttcactacgagcagcggagagataaaaactacgctttttgcgatctttaacgttaatttcacctttagcccagcgtaaagcctgagttaaattgtgtccatctcgtccgaaacgttgctcggtaaaataatttgggaacccatttttcttgatattttctaaccgcactttgagatctgcatcttcttgtgcttcacgcagtaaaatttcaaaatggtttccgtccaagcttcctgtgcgaatttttcgattgtgacgtgttacctcaaggatttccacaccatcaagttgaaattgattaaagtcaggtgtgggttgccccggcatctgtaaacaaaaccattgttctgtaatcgctttacgatctttgagtcctgcatatcccatatttttagcaggtataccagcaaagtgtgccaatttttctgcgacaaatagagtattacaatctgttttacgcactttaacagcaacaaattcgccatcaccggacatttcatagcccagttgttctttcacaacaaaatcagcacagtgtgtttttaaaagtgcggtctgttttggcattgtttgtaaataagcgagttcgttcattactttgtgccagtttgttttattaatagggcaacagcttcacaagcaatgccttcactgcgtccagtgaagcctaatttttctgttgtagttgcttttacattaacctgttcaatatcacaatgtaagtcttgtgcaatcacagtacgcattgagtcaatatatggacgcatcttgggagcctgtgcaatgatagttatatcaacattaccgacttgatagcctttgtctaaaattgcttggtaggctgttcttaataacctgcgactatcagcacctttatattgtatatcagtatctgggaataattttcctatatctcctaaagccattgcacccagtaaagcatcagttaatgcgtgtaatgctacgtcgccatcactatgtgcaactaaacctttttcataagggatagcgacacctccaatgataataggaccttcaccaccaaaggcatgtacatcaaagccatgaccaattcttatcatattttttcctaattaatgctcttttttcataatttgttggatttcagccatcatttcttggtcgacatctaaggctatttgaattaattctttattttcaaagcgagagagttttggatcataaacctctgccatcagtttcacgctatgacaatcttttctaaaatacacatcaccaatttctgctactatatcttcgttcatacctaaagagagtaaggcttgtttacttgttcttaatgccgagtcaaaggtttcacgaatttgaatattggcacctgcaccatacagattgtaaacatgaatacggtcgtgagcacgtgcaataattttaatttgtgggttcattttacgagcttgctcaacaatttgtagagtttgttcgctgttatcaattgctacaatcaataattcggcattttcgacaccggcagcatgtaatagctcaggacgagcagcatctccatagtagcatttaatgcctaattttttcataccggcaattaggtttgcgtctttatcaataatagttgggtgatgccccgtcatcactaacattctatttacaacttgtccaaaacgtcccagaccaattagtatagttggatgttgttcatcaatatgatccgcttttctttccggttgagtcggtttgagacgaggaataatgtatttcttttgagcaataataaagagcggtgttaaaatcattgaaagtacaacaatggctgtcatattcgcttgcatttctttactaatcacattttggctggctgctgaagaaaataatacaaaggcgaattccccaccctgtgccataataaatgctcggtcaatagaattagcattaccggtttttgtgattaaagcgattaaataaattataaatcctttcactaacatgaaaactagtacaccaaaaataattaagaaccaattttcagcaacgacggaaaggtcgagtgacataccgacacctagaaagaacaagcctaatagcaaccctctgaaaggctcaatatcagcttcgagttgatgacgaaaactggattctgaaagtagcactccggctaaaaaagcacccatagccatagagaagcccccctcttccataagtaaagcagagcctagaacaacgagaagagcagctgcggtcattacttctcgagtcttggttttagccaacattttaaataatgggtttaagagccaaagtccggctgccactaaaacagcaaaagccgtgccggatattgcaattttatgccaaagcggatcagttgaagtaactttatccggcgataaaaaagccacaaaagcaagtaatggaacaatgagtaaatcttcaaagagtaaaatcgaaataatacgctgtcctcttggagaggtcagatcattacgctcactcagttcttgcattacaattgcagtagaggtcaatacaaaaccggaggcggcaacaaaagcaactttccaatcaaagccaaataaagtagcaatataagttaaagcactggtacaaagggtaatttgaaatgcacctaagagaaagatatagttacgtagtccccagatatgagagggtttcatttcgagtccaatgatgaataaaaacatcaccacacctaattctgctatatggattattccctctggatctgtaaagagaccgaacccaaagggaccaataactaaaccggcggctaaatagcccaatactgaacctagtcctaagcgtttgaatagaggaaccgcaactacggccgccgctaaaagcgtaacaacgctaacaagtgggtttgccccttctgctaccataataattacctttgttttctagttaaaaaaaattctgccaatgccaagtcttcaggacgtgttactttaatattatcactatgtcctgctactaagtgcggtctaaatccggcaagttccatcgctaatgcttcatctgtgacgataatacctcgttttgctgcttgctctagagcgtgttgcaataagtgtacagggaaaaattgcggtgtttgtgccaaccataattgattacggtcttctgtacattgaatttgcaatactgaatttgatcgtttaatagtatctaccgcaggaatggctaaaatagcaccattttgatcttcaacttgtagtaatgtatctaaattttcattgcgtaaacaaggacgtgctgcatcatgcacaagcacccaggcttttttatttttaatgtgacgtaggccgtttagcacagattccgcacgattctttccgccaataaccatattgatacgaggatttcgcaataactcaatatcaattaaataaggatcattttcagcgacagataaaacaatttggctaattttttcgcaacccaaaaaaatacttaatgtatgctctaaaattgttttgcccagtatctttaaatattgttttgggcgatctgcttgcatacggcaaccaatgccagcagcaggtattatagcaacaatttctctatccatttatctattcttattttttactatacgataaaaaacttcattttgcttgatcatttcatgttccattctggctctttcctcgattgcttctataccattcttcagatcctgaatttcagcaaaaatagtttgattacgttgtgacagcttttggttttcttgtttacgttggataatttctactttgatatcttgataatcaagatagccattttttccaaaccaaaaatcatactgaaacataactaacaaagcgaaaagacttaaaataaataaacgcatttttatctcttatttttcataccaaattctatttatgtacaaagaaactatacctgagggagtggctactttgatttcgtcatcgacttctttgccaattaatgcccgtgctacagggctatcaatggagatccaattctttgcgggatcaaattcatcacagcctacaatgcgatattgtttttcctctccttgctcatcttctaaggcaacccatgcaccaaaaaagactttaccttcttgctttgggttatagtccacgatttgcaatacttccaagcgtttcattagaaaacgaactcggcgatcaatttctcttaaacgacgcttgccgtaaatatattctgcattttcactacgatcacccaaggcggccgcatcggaaacagcttgcgtgattttaggtcgttcgtctttccataaatattttagctcttgatctagaatattccagccggaacgagtgatataattagatttaggcattgtatctttcctttcaaagagagcgaaattgtaacataagatcaataataaatatgtgaagaatagttaaaattacagttaattttacaattttttccaataattgtttgaactattacgttaaactcagtatgctactgcgaattttttaaacagaatataatagaaatagagacaagatgttaaatcaacaaatcgccggtattattgcgaaagaattagctgttctgccaagtcaaattttatcggctatccaattattagatgatggcaatacaattcctttcattgctcgttatcgtaaagaaatgaccggtggattagatgatacccaattacgtcattttgaaacacgtttaatttatttacgtgagttagaagatcgtcgccaaacgattctcaactctattgaagaacaagggaaattgacagatgaattgcgtagtcaaattgaacaaacgcaaagtaaaactgaattagaagatctttatttaccgtataaaccgaaacgtcgcacaaaagggcaaatcgcaattgaggcaggaattgaacctttagctgatttgctttggaatgcacctgagaatgaaccggaaatcgttgcggcagattatatcaatgcggaacaagggtttgcggatataaaatctgtgcttgatggtgctcgttatattttaatggagcgttttgccgaagatgcacaattgttggcgaaaatccgccaatatttacagaaaagtgcggtactggtttccaatgttttagaaggcaaagaggctgagggagaaaagttccgagattattttgaacatcaggaattactccgcaatgttccttctcatcgtgctttagctatgttccgagggcgtaatgaaggctttttgcaattaaggttgaatgcggatcctgagcaagaagaaggtgtttgtcatagttattgtgaagaaattattcgagagcatttgggtattcatttaactcagcaaccagcggataagtggcgtgagcaggttatctcgtggacttggcggattaaaatctctttacatcttgaaactgaactgatgagcagtttacgtgagaaagctgaagatgaggcaattgatgtttttgcccaaaatctaacttcattattaatggcagcacctgccggagcgaaaaatactatggggctagatcccggtttaaggacaggtgtaaaagtcgctattgttgataatacgggaaaattagtggcaacagagacagtttatccacataccggacaaatgaatacggcaatgtcagttatttatcaattaattaagcaacataatgttgagttaattgccattggtaacggcacagcttcaagagaaactgaacgatttgctaaagatgttattaagaaaattgagcaaaataaaccacaaacagttgtggtcagtgaagcaggtgcatctgtttattccgcatcagaattggcggcacaagagtttcctgaactggatgtgtctttgcgaggtgcagtttctattgctcgccgtttacaagatccactggcggagttagtgaaaattgaaccgaaagcaattggcgttgggcaatatcaacatgatgtaaaccaaactcagcttgctcgtaagctagatgcggtagtagaagattgtgtaaatgccgttggggttgatttaaatacggcatcagcacctttacttgctagagttgcaggtatgactaaacatcttgcacaaaatattgtggcatatcgtgatgaaaacgggcgttttgaaagccgtaatcagttaaaaaaagtaccgcgtttgggtcccaaagcctttgaacaatgtgccggttttatgcgtattgcacaaggtaaaaatccgcttgatgcctctggtgttcaccctgaggcttatcctgttgttgaaaagattttacaggctacggaaaaatctattcaagatttaatgggaaatgtgagtgctgttcgacaattagatgcaaaacaatttactgatgagcaatttggaatgccaacagttttagacattttcaaagaattggaaaaacccggaagggatcctcgaggtcaatttaaaacggcggtatttatggacggtgttgaagaaatcactgacttaaaagcaggtatgattttagaaggatctgtaactaacgtaacgaattttggggcatttgttgatatcggtgtgcatcaagacggtttagttcatatttcatctctttccgacaaatttgtggagaaccctcatgaagttgtgaaaacaggcgatattgtgaaggtcaaagtgttggaagttgatgttgcccgtaagcgtattggactaaccatgcgtttagatgaaaacccgtccaaaaccgaccgcacttcagtcaaaacgacctcagtccatgtaaaagaagtgaataaaaatcggaaaagtagcaataatgttatgggaaatgcgtttgccgatgcgttaaaaaattggaaaaaatagttttagtacagggtatttgggtattaagttatgatgggtttaattgtataacacaggaaattttatatgaataaaaacactttttttgtaggctttatgctgtttgctatcttttttggtgcagggaacttaattttccctcccaagttgggatttgatagcggatctgaatttattccttctattttaggctttgtattaacaggggttggcttaccgctattgggcatcgttgttagtgcattttataatgggggatacaaagaagcacttaaacaaattcatcctgcattttcattaatttttttaattgcgatttatttatctatcggccctttttttgccggaccaagaaccggtgcaacagcttacgaatttgtgattctaccttttatgggggaagcaacatcaatttctaaactggtattctttgcggtctatttttcattgactttatggctaagtttaaatccgacgaaattagtcgatcgtatcggctctattttaacgcctattttattggtagcgattatcgcattagttatccgttctgtttttttattaagcggacatgatattccaagtgtaacggtgaatacatcaggtagcttttttaatggcgtgattgagggctactttactatggatgccctagcatccgttgctttttctgtggttgtgttaaatgctatacgaaataaaaccgacctaagtgcttcattaaaacagcaaacaatttttgctgcatttattgctgccattgccttgggtttaatttatgtagcattaggatggattggaaacaatatttcaattaatgcggatgtattagctgatttgcaagccaaaaaacaagaccttggtacttacattctaaacgatgtaactacattagcttttggtgagttaggtcgtacgttgttaggaattatcgtttctcttgcttgtttaacaactgcggtaggattagcggttgctgtgagcgaatattttaatgagatttatccgaagatttcttacaaaacctatgttgttttattttgtttagtgagttttgtaattgcaaatttaggcttaaaagaagttattagtttatcattacctgtattgctaatcctttatcctattgcaatgacagtgattttgttgctttttgttaatattattttcccgacgccaattttagctcatcgcttatctttaggattggtgactgtcgtgtctgttttatcggtatttggggttggaaaaattgagtttatcgagcaacttccactaaaaccttactctatggaatggctaccttttgcattggttggatttattttaggatgttttttacacatattcttcagtaaagaaaaatcagtgttaaaaagataagatataaaaatgagggcatattcaatgcccttattttctagtagtaagagtgttcaccccgctggtgttcagttacgtcttttacacctgtcaattcatcggcaaacattgctaataattgtttttcaatgccatcttttagggtgacatctaccatcgaacagccattacaccccccgccaaattgtaaaatagccttgccatctttggtaatttcaatcaaggtaatatgcccgccatgtcctgccaattgaggattgatttgcgtttggatagcatattccacacgttcaatcaaaggtgcatcatcagctactttacgcattttagcattaggtgcttttaaggttaattgagaccccatttcttcagttatataatcaatttcagcatcttctaaaaaagggaaactgacttcatctatgaaagcagaaaactcactgtattttatttcatgatctgttgtttctacggcatttttagggcaataagacacaccgcattctgcattaggagagcctggattaacgacaaaaattcggatatttgtaccttcttcttgttgatctaaaagacgacgaaaatgtgcttgtgcagcctctgaaatggtaatttgcataaattaatattcctagcaatacttgagtaaaattatcaggaatgatactcctagaccgctcttttttccagtaatattacttagtttttatgttaagtttttgccagtccccatacatgaataacgttaattcctgcttgttttaatagttttgctatttcatttaatgttgagcctgttgtaataacatcatcaattaaagcgatggaatgatattgttttgctcgcttaatattcacgctaaaagcgttgtgtaaattagatcgtcttgctttttcatttagtcctcgttgcatttttgtgtatttttggcggacaaccagtttattatccagtggaatcgaaagttggcgtgaaagttgtttagcaattaagtacgcttgattataccccctgtaccattgacgaaaatgatgtaacggaacaggaatgatgacttcaggcaaactgaataaatactctcttcttgcatggtaaatcgctaacaacattaattgtgccaaagtgcggtctaaataatagcgattttgaaatttgaattgatgaataagtgtggataaaggtggttgatagcgtccaataactaccatttgttgccaatttggtgattgttttgcacaattcccacaaaacatctgtcctctaaaggcttgattttttgataacacagcaccacaacgtccacaataatttaagcgagaaatttgtttatcacattgataacacaaatgacggtgtgcaaaatttaacggtttttgacaatggacacagctaaaattaaaccagttcacttaagttataacctccagagtggaaaaaagtgcagtattccattcaggaaaatatagatcaaaagattagggataatttctcgatcttaatcacaaaaatgctagaattagccaggctaaactaatcattttatgaaggaaaatttatgtctttaactgactatcgtgaaaaaattagcatggtattttttgatattgacgaaaccttattttcaaaagaaaaagatcatttaccggcaagcacttattttgcattaaaatctttgcgtgaaaaaggtgttttggtaggtattgcgacagggcgtgcacgctgtacttttcctgccaaaatcaatcaaatgattgatgaattagggattgatatttttgttactgccaatggacaacatgttgagtatcaggggcggatattagcccgttatgcaattgacaaaaataaattgtacaaactggttgagttttttgatcaacatggcattgattatgttcaagtagcgaacactgagattaaaatttccagcctcaatccaatactcactgatgcttttaatccaattagtacgaattatcaagtagatcctcgttattttgaacggcatgatgtattacaaattttgtcattctatgaggataaaagctacgatgaattaattgctcaatctaatattttagaagggttaaaaacagtgcgttggcatcctaattcagtggatatatttgataaagacggttcaaaagcacggggaatccaagttgttgttgagcatttaggtttgaatatggaaaatgtgatggcatttggtgatgggcttaatgacatagaaatgctaagtgcggtcggtgttggcgttgctatgggaaatggtcatgaattgttaaaacaacaagcgaattatgttactgatcatattgaagaaaatggcatttataattttttacataaagttggtttggtgtaattttaacaaggttaaataacttataggtcgctttttattttctcggcatcattatcctcagtaagaattcaccgcacttttctattagctatgataaacttattgcccttttaggttgatgatgagtgtttatgaagaaaattttattcattgtattgttgtttttgtgtggtgcaggcggtagcgttttttgggcatattggcaaataactgactttgtaaaacaacctgttaaagtcaaagaagagcaacttttaactgttgtgcgaggaacgaccggcaataaattggcaatattattagaaaatgaagggttaatcgaaaatgggaaatggttgccttggctgcttaaattaaaacccgaattgaataaaattaaagccggtacttattccctcgttaatgtagaaaatattcaagatcttcttgatgtacttaatcagggcaaagaggtgcaatttaatttgcaattgattgaagggcaacgttttaaaacttggcgtaaaattttagaaaatgcaccgcacttgcggcaaacattacaaggaaaatcggagaaagagatttttactttgctggagttaccggcttattcaaaagctgtttatgaatggaaaacgattgatggttggttatatccggatacttatagttacacgcctaactctagcgatttggcactgttaaaacgtgcggcttcccgtaccataaaagcgttggagcgagcttggcaacaaagaaatgtaaatttgccattgaaaaatccctatgaaatgttaattcttgcttctattgtggaaaaggaaacagcattgactgaggagagagcgaaagtagcgggtgtttttgtgaatcgtttaaataagcaaatgaaattacaaacagatccaacggtgatctatggtatgggtgatgattataaaggtaatattcggaaaaaagatttattgacaccaaccccttataatacctatgtgattgatggtttaccgccgacgccgattgctatggtaagcgaggaaagtttacaggctgttgctaaaccggaacagcatgattatttatattttgtcgcagatggaagcggtggacacaagtttagtaaaacattggcagaacataaccgtgctgtgcaagaatatttgcgttggtaccgttctcaatcaaaatagtgaaataaaatgaaaacaggaaagtttattgttattgaaggcttagaaggtgcaggtaaaagcagtactcatcaagttgtggtaaataccttgaaagagtttggtatccacgaagttgtttttactcgagagccgggcggtacgcctttagcagaaaaattacgttatcttattaaacacgaggtagaggaacttgtcacggctaaagcagaattgctcatgttgtatgctgctcgagttcagctcgtagagaatgttataaagccggctttagcaagaggaaaatgggtagtgggagatcgtcatgatttatcttcacaggcttatcaaggaggcggtcgaggtttggatcggcatttgatgacaacgttaaaaaatgctgtgttgggcgattttaagcccgattttacgttgtatcttgatattgaaccggaaattggtttagcaagagcaaaaggaagaggggaattagatcgtattgaacaacaaaatttagatttttttcaccgcactcgagcaaggtatttacagttagtgcaacaagatcctaatgcagtgctaattaatgcggggcaacctattgagcttgtgcagcaagatattcgtaaagctgtgcaaaaatttattgaagaaaatgtgtaatttatatccttggttacaaccttattatcaacaaattatccaaccttttttacaagagaaagggcatcatgctttgttatttaaagctgaacaaggaataggtatcgagcaattgattgaaaatatcgcaggttggttaatgtgccggcaaaaagatgccctacaatcttgccgacaatgccaaagttgtgcattattcagagcaggaaatcatcctgatttttatcgacttgaatctcttgacaataaggatattggtgtcgagcaagtgcgagaaatgaatgaaaaagttagtcagtttgcaaaacaaggcggaaataaagttgtgtttattcgtcaagctgaacgtttaactgaaagtgcggcgaatgcgttactaaaaacgttggaagagcctagaccgcatacttattttttattacaaatggacttttcggctgggttgttagcgacaatttatagtcgttgtcaagcttgggttattaatacgccaacagagcaacaaggtcttgtatggttgcaacagcagcgtcaggaaaaaatcgcagatttacaaaccgcacttcgtattaattataatcgtccattgctggcattggattgtttggaaaaggggttattagaacaacgaacgacatttttacgtcagttttggttgttttatattcgacgttctcccttggagttattaccgcactttacgaaagaaaatgttttattacaactggactggatgagtgcatttttacatgatgcactcaaagaaaaattaggtgttcggcaaggttggatcagccaagatttagctcgtggcattttgcaatttaatgaaaagcaaaatgtggaagagttgttaaaagcaattcaaattatccaaaaaatgcgtttgaatctaacgcaaatcaatggggttaaccaagagttaattttattagagggattgactcgtttggtaaccgatgtatttgaaaggaaagaataggaaaagaaatgtttattgtggatagtcattgtcatcttgatgccttggattatgaaaacttacatacagatattgccgatgtggtggataaagcaaaacagcgtgatgttaaacatttattggcagtaggggtaactttgaagcgttttgagcaggcttatgcacaattagccttatttaaggaagtttccctcgcttgtggtgttcatcctttggatttggcggaagaaccttttgattatcagcgtttattgaggttggcacaagatgaaaaggtagttgcgataggcgaaaccggattggattattattacagcattgaaaataaagctttgcagcaatctgtttttgcacaacaaatagagattgcaaatcaactgagtaagcccgtgattgtacacactcgatccgcccgagacgataccattgccattttgcgagaaaataatgcacaaaagtgcggtggtgttttacattgttttacagaaaattggggaatggcaaaacaagcacttgatttagggttttatatttcgatttcaggtattattacctttaaaaatgcacaagagttacgtgatgtagtacgtcaagtaccattagagcgtttgttagtggaaacggatagcccttatttagcaccagtcccgtatcgaggtaaacaaaatcagccggcttatacacgtgaagtttgtgaatatgttgcaacattgaagggattatcagcggaagactttgcacaaattactacgcaaaattttgagcgtttatttaagattaatgtacaataaagcaacgatttacagggggagttatttatgagaaaaatatttaaaaaggtagtgttggggttactattcttattccatgtttttttattttctgtggtgcattatgttacgccacattatgatgttaccaaagttaccggtgtagaagtaaagagagttgataaagatggacctattactaaagctaatccggccgacggtccgactcgtgatgtgtattatatttacacgcaaaaaccgaatgaggaaaacgtgatggtgtatcgtaatgaagatacacgttggagttttccattttattttaaattcggttccgccgatttacaggcaaaagcccaaagtttttcagtggatcataagttagtggaaattaagtattatggttggcgtttggttatgtttgatgaattccgtaatgcagtgtcagtcaaagaggtgagtgcggatacagaagcttctcattccattttagcttatgttttttacgcatttttattgattacgttatttttctctatccaatttgtgcgtggttggtttgatagtgaagactaactttttggtttgatatgcttctattctcatcagaagctactttgttaggcattgaatattatgagcttattacaggcaatattagtcattattggcttaattattattagtgcggtcgtttcttccgctgaaatttcgttagccggttcacgtaaattgaaattgcaaatgttagcgaatgagggtgataaacgagctgtgcaagtattaaaattacaagagcaaccgggacgttttatcacagttgtccaaattggactaaacatggtggcaatttttggagggattgtgggtgaaagtgcaattcgcccttttttacaggagattttaagtgcttatacgcaatctttttgggtagaaagtgcggcttcttggctggcttttattattgtcactgtttcttttgttctcttcgctgatttaatgcccaaacgtttagcgatgacaagtccggaaaaagtagcattgtcaacagtaggaataatgtctttttgcattgttatttttaaaccagtggtcttaatttttgatactattgcgaacggaatttttcgcttattgggaatttctaccatgcgggaagagagtatgacgccagcggatattgtcgcaattgtagatgccggtgctgaagcaggtgtattaaaagcacaagagcattatctgattgaaaatatttttgaaatgcaagagcgtacagttacgtcaactatgacgactcgtgaaaatattgtgtttttagaccgctcttttgagcgtgagcaagtcatcaccacaattaaaaataatccacattcaaaactacttatttgtgatcatggcttagataaaattttgggctatgtggaaagtcataatttattaactttatatttgcaagaacaacaagtttctttaaccgagcctagaattttacgaaaggcattatttattcctgatacgctttccttatatgaagtgttggagttgttcaagtcttctggtgaagattttgcggttattgtaaatgaatatgctctcgtagtggggattgtaactttaaatgatgtaatgagtattgtaatgggcgaattagtttctaatgaggaagaacaaattgttcgccgtgatgaaacatcttggttgattgatggtgcaactcccttagaagatgtagcacgggcattggaaattaatgagtttccggatgaagaaaattacgaaaccatagggggatttatgatgtatatgctacgtaaaattccgaaaaagacagatttcgtattatatgatagatataaatttgagattattgataccgagaattttaagattgatcagttgatggtatccttaagaaaggatatttagacaagattcaaaagagagtaaaccacatcttcgctttctttagatattatcagtcaaatgcaattaatgggatttttcttataaaaatagaaggttatgtaaaagagataaaaagcaatccgaagattgcttttttgttccgcttattgagcaagtgcacgttttaattttaggatagtcgccttccctttatcttcatcgacttgtttaagattggctccgccaacaaatgcaccgggtttaatatattggcgaataaaataattttttccgccatctgtcgtaatatcaaggtgattatcactaaactctgattctgttgagagcctatgattacctgggattacacgcttgtaaaaatatgttttgggtgcggattcaccaataagtttgccatcgatataaagattcttcttcaacgcagctccaaatattgaatcacgataaatataaatccctgattcatcctttgatggaagcaaaaactgtttagccaaagcatcattttcaggggtatccatcaccgttctggcacaaccggtaagtcccaaagtgattgccagcaagagagttgaaaaaaatttcatttgatgtctagcccatacgacttagaagtaataacttgcactcaatgacaagctttgtggcttgaagcgaatatcgccttctatattgcggaggaagactttttgatattcaacacccacatcaaatttatccgttacggcatattttacccctacagctgcaccaataccgacaacagagtttccttttatggtgcaactatcacaaattttcttggcattaagatcataaaaatgactatttaaactcactttaagatacggcatgaaattgttactaatgcgatagccttgaagatagccaacactgaaagaaaatttttctttggatagtagttcgttattagaagtgatttttgaaccgccggtacgtaattttacttctgcttgtcccacaaaattactgtcaccaaaattaaagccgtaaccaccgaataaaccaaagcctattttgcctgattttttttgggtttcgctttttgctgttttagaaagcgtacccttataaccatgttttgaatgatgaacttctccacccataaaaaagccagtgaaagtatcttgtgccattgcaccacttgccatgcaagataataataccgttgcagcgatagatatttttttcataaataaatcctcttaataaagattaagttaaatttgaaactattttattgttaagagaaaactaagtcttaagatcttaattttcaaagatatattctacataggtatattatgagcaccatagacaaataagacattattagtctaataagtagaaaaatagtctaaaaagaggaaatgaaaaaattatttacatattgtctgaaagtatttaaacgaaaagagcggtgtaaattttaaaaattcgtaccgctctttttctatatcagttacttaaaaagaatattcatgtttctgcgatgttgcagctggtattttctattaagaattataatttaggttcaccaattggtaatatggttttaccaaaactttcattgataatatcagcggcagcgagatagaacgctaaaagtgcggtcaataaaccaaagtttccacctagttggctaaagttgtgattaccggtaaaatcgcctgcggcaagtaagtagaaggtgatggttaacgctaagaaaatagcctgtaatgcacgagtttttgctaatgtgccgataaacatcatcaatgtgaatgttccccacgccgctaagtaccagcctacaaaagatgatgtgacaccttgtgagaaaaataccttgaataaggcaaaactccaccaaaatgcaccatagctgataaatgcagtaaaaccgaaagtattaccttttttgtattcaaacataccggcgatcatttgggctgtaccaccgaacgcaaatcccatggctaatactaaacctaaattttcaccgctgaacataccgttattgattaaacttaataaccaagttgttaatgcaaatccacataagcccaatggtgccggattcgctaagttatcttttgttgtcgacattatattttgcccttaaattaatttgataaataaaaaaggcgttattatctatgattttattgaataaataaagattggtatgaaaaacgctaggataagaacaatgaaattgggaaagtagctagaaaattaattattttttgtttttcgctattgttatttagatgtaaaatacgttcagctgagttttaagggtaaaatacgatgagcgtttagtcgccacttagtctgcaaaatgcgaaatgttaaatcacaagcatgtgagtttaaggattggcaagaaatgttatcatcaagttaaacgtcagtttctcgtttttacgcctaaagttgctggagcacatcattggacacaggtaagctcgacattagaggggagttagaataaaatggatttcgttttctaacagaagaaagtaattgtttttaaaaggaaaatttgttgaatactcaatctaagcaaaacgctagttttgtttttattttaaccttaggcattttatcaatgttacctccacttggagtggatatgtatttgccggcatttttaaatattgcacaagatttgaaagtaagcccagagcaagtgcaacatactttgactttttttacttatggtttggcagcggggcaattattttggggacctgtgggagatagttacggacgtaaaccggttattttattaggtgtgattgttgcgactattacagcatttattttaaccggtattaataatattcaaaatttcaccgcacttcgttttattcaaggcttttttggtgcggcacctgtggttttatccggtgcactattacgagatttgtttagcaaaaatgagctttctcgaatgctatcgatgattactttagtgtttatgattgctccattactcgctccaattattggcggtaatttgatgcgttttttccattggcatgcaattttttatgttatctcggcaatgggaatgctaagtgcggtattggttttttatgttattccggaaactcataaaaaagaaaatcgcattcctctcagattgaatattatcgcacgtaactttttttctctgtggaaacagaaagaagtactgggttatatgtttatgtctgcttttggttttggcgggttatttgcttttgtgacagcaggttcaatcgtttatatcggactttatggtatagccgttgaaaattttggttatttctttatgttaaatattggggttatgattattgcctcctttatgaatgggcgattggtgtttaaagtgggtgctgaacgtatgctacaggttggtttgatggtgcaatttatcgccggtctttggttagcattcgttgcgttttttgatttaggtttttggtctatggcaattggtgttgctttttttgtagggcaaaatccattaatcagttcgaatgctatgacatctattttagagaaatttccaactatggcaggaacatcaaattctatggttggaagtgtgcgtttcggtatgggggcaattgtggggacaattgttgctttatttgaaatgaaaacggcagcaccaatgcttttaacaatgacgatttgttctttgcttgcggtaagttgctattattttttaacttaccgtcatttaaaaaaataaaggaagatcatggcattgcaaccttgccctgagtgtcggcgtaaaatcagtgagtgtgcgataagttgtccacattgcggtttttcgttacaagaagaaaatttgatgctatatcgtgaaaaactaaaaaaacattgtcagtataatcaggagattaaccgagcaagtattaaaatccatttattttggttggcggtgttttctatagtgatcgggattgtcggttggttaagtaattagtcgttaaaagatattcaagcccctgtaataaggggcttttttgtatggtttaactttttgttttcattgctggaaataaaattacatcacgaattgagttagcgttggcaaataacatcgctagacgatcaattcctaaaccctcaccagccgttggtggcaatccatgctcaagtgcggtaacaaaatcttcatctttaaacatagcttcatcgtcaccagcttcttttgctgcaacctgtgcatcaaaacgctcattttgatcttctgcatcatttaattctgagaaaccgttaccgatctcacgtcctccgataaataattcaaagcggtctgttacgtcaggattttcatcattgcggcgtgctaaaggggagatttctgccggatgagccattaagaaagttggttgaattaaatgatgttcagcaacttcttcaaaaattgcattgactaagctacctagcccccatgatttttgtacttcgatacccaatttttgtgctactgcaacagcacgatcgaaatcgtataaatcttctttcacaataccttgctcggcaccgtattttaagattgcctcgtgcatggtaatacgttcaaacggtttgccgaaatcgaattttaaatcgccgtaaggaacaatggtcgtacctaaaatatccagtgctaatttgcgtaaaagttcttctgtattgtccattaaatcgtggtaatccgcataggcttggtagtattccaacatagtaaattcagggttatggcgaatagaaacaccttcattgcggaagttacgatttaactcgaatacacgttcaaaaccgccaactaccaaacgttttaaataaagttcaggtgcaatacgtaaatacatatccacatctaacgcattgtgatgagtaataaatggacgtgcagatgcaccgccaggaataatttgtaacataggggtttctacttccataaatcccttggaaatgaaatattcacgaatgcctgcgattactttagatcgaataataaaagtgcggcgtgaatcttcattagcaattaaatctaagtagcgttgacggtaacgagtttcttgatcgctcagtccatgaaatttattaggaagcgggcgtaatgctttagttaataagtgaacttccgttgcacgtattgtcaactcattggttttagttttaaataaagtaccttttacaccaacaatatcccctaaatcccaattgcccacatcatcagtataaacaccttcagctaggttatcacgagcaacataaagttgaatttttccgctcatgtcttgcaatgtgataaaggttgctttacccatgacacgacgagtcataatacgccccgccacttttacttcaattccctgtgtttttaagctctcactttcaatttcatcatattgtgtatgtaagtcctgtgctaaagcattgcgacggaatgtatttggaaaggcgttgccttttgctcttaacgcagctaatttttcacgacgaaccaacatttcgccattgagatccaattcttgaattatttctgtcattatgtactcctcttggaaagtcacttgtagaataaatttgtcatttgaataaaatattgtggtttttgaccgctctttatagtccggcttttaagctggcttcaataaaacgatccaaatcgccgtccaatacagcttgagtattgcgattttcaacacctgttcgcaaatctttaatacgggaatcatccagcacataggagcggatttgactaccccagccgatatcagatttactgtcttccatggcttgtttatcagcattttttttcatcatttccatttcgtacagttttgcttttagctgcttcatggcttgatctttattctgatgttgagatcgtccattttggcattgcaccacaataccgctaggaatatgagtaatacgcaccgcactttctgttttattaacgtgttgtccgccggcacctgatgcacgataaacatcaatacgtaaatccgcagggttgatttctatttcaatatcatcgtcaatttcaggataaacgaaagcggcggcgaaagaagtatggcgacgattattggaatcaaatggacttttacgtactaaccggtgaatacctgtttctgttcttaaccaaccgaaagcatattcgcctgcaatacgaatagtggcagatttcaagcctgcaacatcgccactggaaacttcaactaattcggttttaaagcccttgctttctgcccaacgtaaatacatacgcaatagcatttctgtccaatcctgagcttctgttccgccggagcctgcttgtaggtcaacataacaatcacagttatcatgttgtccgctgaacatacgacggaactcaagggcggcaagttttttttccaattcttccgcttctgcgacagcttcattaaacgttgtttcatcttccgcttctacagaaagttccaataagccatcaacatcttccagaccctgctcaagggcttttattgtattaacaacaagctctaaattagaccgctctttgcctaatgcttgagctttttccggttcattccaaatatccggttgttcaagttctgcatttacttcttctaaacgttcaacttttgtatcaaagtcaaagataccccctaagcatatttgtacgctcagtgagatcgattaatttattttttatcggattaatttcaaacatagcttttcccaatgataacaagtgctgaattataagctattttgctgatgttgggtagttgcagattagattgttcaaaggatttatgttagaatttcgtccgttttttactgaaaattaggaacttaaaatgaaaaaatttttaatggtaagtttagccatgttgatgtcaacttttgtaaaggcagataataatgtcacaattcgcaaaaatttacaaaaattaggtatgactgatgtagaaattatggagtctcccattaaaaatataaagagtgttttgacccgtgaaggtactctgtatgtttcggaagatggtaaatatgttttacatggtgctttgtatgaaattactgacaaaggtattgtgaatttaacgacaaagtctttattggtaaaactgaataacttaaaaaatgagatgatagtttatccagcgaagaaggaaaaatatgttattaccgtattcatggacattacttgccattattgtcatttattacatcaaaaaattaaagaatataatgagttaggtattactgttcgttatttagcttttccacgtgccggtctaaatagcaatacagcaaaacaaatggaggcgatttggacatctcgagatcctgttttcgctttagatgaggcagaaaagggcaatttaccgaaagagctgaaaattccaaatatgattcagaaacattatgagcttggtattcaatttggagttagtggcacaccaagtattataactgaaagcggcgaagtgattggcggttatgtagagcctaaaaaattattgcaagtattagaagatattcgtgaataagtttattaaacgacgtgatgttgcgatagatgttcaagtttgtgagcatcctttattggaccgaatttaccgtgcacgtcaaattaaaaatcctcaacaattagaccgcactttgaaatctatgttggcacctgatttgctacatggtattggaagtgcggtggatttattggtaacagcgagagaaaaacaacaaaagattgttattgtcggtgattttgatgttgacggagcaaccagcacagcactcattgttttggctctgcgtcaacttgggttcacagatgtagattatttagtacctaatcgctttgaacaaggttacggtttaagcgtggaagtagctaagttagcattagaaaaaaatgttgagttattgattacagtagataatggggtatcttcttttgatggtgttgtgtttttaaaaaatgcgggagtgcaagtgttgattacagatcaccacttaccgccggaaatattgcctcctgcccatgctattgttaatccaaatcttacacaatgtaattttccttcaaaatttcttgctggtgtcggtgtcgctttttatgtcatgctggcattgcgtgcaaaattacgtgatttagggatttttactacgcaaacccaaccgaattttacagagttattagatttagttgcccttggtacaatttccgatgtggtaccgcttgatcaaaataatcgtattttagcttatcaaggtttagccagaattcgagctgagcgttgtcgtcccggtattcgtgctttggcggaaattgcaaatcgtaatatgagtcgattgaccgcttccgatttaggcttttctattggtccaagattgaatgctgccgggcgtttggacaatatgtctgttggtgtggagttattattggccgatgatatgcaacatgctcgtcaattagcttttgaattagatagtttgaatcaggctcgtaaagaaattgagcaaggtatgaaacaggaagcgttagaaatttgtcggaatttgaccgcactttctaagcaattaccgctgggcatcgtactatatcaggttgattggcatcaaggtgtacttggtattttggcttctcgaattaaagataaatttcatcgaccgaccattgcgtttgctcaggatcaagtcggaattttaaaaggttcagcacgatctattgaaggtttacatatgcgtgatgtgttagagcgtattcattctcgctatccggatatgattttaaaatttggtggtcatgcgatggctgctggtttgagtattcgtgaggaattgtttacacaatttcaacaagcctttattcaaactgtgactgaatggttaaaagaagaacaattacaaggtattatttggactgatggtcaattagcacccgcgtttttaaatttggagacagcggaattactgcgtcaagcaggtccttgggggcaaggttttccagagccgtgttttgatggtgaatttacaattttacgccagagtattgtgggtgaaaaacatttaaaaatgcttgttgagcctaaacaaggaggtccgctgttggatgctattgcatttaatattgataaggattactaccctgatttttcgataaaacatgcaagaatagcttataaattagatagtaatgagtttcgtggaaatcgtcatgttcagttgttggtagattatattgaacctttagatcattaaatttatttttcggcactggtacataataatgttttagggacaataaaaatgacagaagaatatggcgtatttacttatccctatgtcattattaatggtaaatatgttttgacagcaagtactttatataacgatgattatagtgttgcagtgcttgattttttaattcatcaaattcaagtggagagcaggaaatgaaagtaggtattgttggtgcgatggcacaagaagttgagattttagcgagtttaattgagaataaaaacgtagttcatattgccggctgtacaatttatcaaggaaacattcaagataaggaggttgccttattacaatccggtattggaaaagttgcagcggcaatgggaactacactattattgcaaatgtttaaccctgatattgttattaatacaggatctgccggcggcgtatcctccggattaaaagtgggtgatgttgttgtgtctactcaaactgtttatcatgatgctgatgtgacagcctttggctatgctaaaggtcaactgcctgcttgtcctccagcttttatttctgatccaaaactgaccgcacttgttgcaaatgttgcaaagcaacaaggcattaatctgacttccggtttaatttgctccggtgacagttttattaatagtgcagaaaaattagcttggataaaagcaaattttccagaagttgttgctattgaaatggaggcaacagctatttctcaggtatgtcataaattcaatattccgtttgttgtcatacgggcgatttctgatgtcggagacggtgaagcaagcatatcttttgaagagtttttgcctttagcggctagacagtcttcctctatggttctaaagatattacaaagtttgtagggaattgatttattataaatatcaacttgataaataaagaaaaaatctccaaatnnatctgcaccccaaaagttggactaaaccgttaacaagttaaggcacagattttttatgactaaatataatcaatcttttaaccaacaagtgattgaattttatcttcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattcggagattttttgttttggattattttgagcttggaatgctgaaacgcttgttgaaacgttctacacgaccgccggtatcaacaacacgttgtttaccagtatagaaaggatggcagttgctacatacgtccaagttcaaatttttacccactgttgaacgagttttaattacgttaccgcaagaacacgtcgcagtaatttctttatattcagggtgaataccttgtttcatagaaaacctcttaaaaatcactccgctctccaaaaccgaatttggcaccgagtgctgttaatattacgccatctaaaggcaatttagtaagatggcagattataccgaaaaaatgggctttttcaagttatctgtataaaaaaccgcactttatccttgcatgttaaagtgcggtataatttgcaacaattttttacattgctgtccaaagtaaaatggcaagcaactgaggcgacataatacgcaggaacatagaaagcggataaacagtagcgtaagataatgcagctataccgctatcttctttaattgcattggcaaaagctagtgcgggaggatcagtcattgaacctgcaagcaaaccgcataagctgagatagtttaatttcatgtataagcgagcaataatgccggtgatcattaatggaataaaggtaatgaacataccatatcccatccattcaaggccttgaccattaaccagtgtgtcaacaaatccgcctccggattttagtccaacaacagctaggaataaaacgataccgatttcacgtagtgctaagtttgcactgggcggcataaaccaatagagtttaccgacactaccaatacgagcaaggattagtgcgacaactaatggacctccggctaaccctaattttaatgctacagggaatcctggaatgtagaatggaattgagcctaatagcacgcctaatccaattccgataaataccggtaacatttgaacttgttgtagtttttgttgtgcattgccaataattgaggttgcattaccaattgtatcggatcgccctacaatatgtagcacatcgccaaattgtaatgcggtgttggctgttggaactaactctacgccggcacgatttaaacgtgaaatcacaacgccatattttttatgaattcctaagtgttttatgcgtttaccaagcactttttcattggtaacaacaatacgttcagagcgaagatctcctgctaaatgagtcataggcatatcaatttcctcacctatcactaatttcatttttttcaaggcattgatttcaccaactaaatgtaatacgtcatcaattgctattatggtatctgcacttggtacactaatattttcttgtcgttttaaacgagaacaaaccacatctttattgtcaaagccgggaatatcaattaatcgtaaaccacttaaatttggattggtcactttaacatttactgttgttaagctttctttatcctgtccgctggctttttggaattgtttctcttcttcttcaaccttaattttaaaaaataaacgaattaaccacatgctaagtaaaatgccgcaaatcccgaaaggataagccatagcgtacgccatacccattgtgctgttagcattttctatgcccagttcagtgagaatttgttgacccgcacccaaggatggcgtattagtgaccgcaccggagtagataccgagaataatatcaagatcaacattaacaactttatataggacaaaaacacttactgcaccgagaacaacaattaatgttgctaagccgttaagttttaaaccagcagaaagtagagaggcgaaaaatcccggaccgacttgaatgccaatggtataaacaaatagaattaacccaaattcttggataaagtgtagagtgtgtgcatctaatttcaatccattttggttcataaaatgagcgacaataatcccaccgaataatactcccccgatgcctaaaccgactccgcgtattttccaatgccctatccataaaccaataacggcaacaagggctaggatacaaattgtgatagcaatatcactcataccgacctcttttaaagttaaatataaaaaatagctactcgaattatatcaagctcaattcaaagaaacgataaaaatctaaaaaatgtaggatttatcacatttttcttgattaagttatggtttttattaacaatatttgaaaaaaattaaatttcatttaatccctttattataagaggcgttgagaatacaaaatgaattggacggaagaactttttacatcgttactttggatagtgaaaagcttatttatagcaagcttggttttctctttaattttatattttttgataaaaatgacccgatggggacatcaattttggctattagcgaaaagttatttatcaccacgtcatagccttatgcctttgtgttatttttgggtaatcgttttttttgacttattatccgtgcgtttggacattttattttccagttggtacaagtccatgtatgatgccttacaagaaatgaacgtagttggattctggcagcaaatggttgttttttcccttttggctatggttcatatatttaatgttttgcttacttactatatttctcaggatttcaaaattaagtggagaacttggcttaataatgaaatgttagataaatggtctgaaaatcaggcttactataaaacccagtgccttgctcatcaattggataatccggatcaacgtattcaacaagatgttgatgcctatgtttctaattcattaaactttgctacaggtgttatttcttctacagtgtctttagctgcatttaccgtgattttatggaatttgtcaggtccgatggtaattatgggctatgaaattccacatatgatggtattcttggtttttatttatgtattagtgagtagtgtaattgcttttagaattgggcggccattgattcaattgaattttgttaatgagcgtttaaatgcaaactatcgttattcattaattcgtttaaaagaatacgcagaaagcatagctttttatcgaggggaaaatatagaaaaatcgatgttattacgccaatttgaaaaagtaattggtaatttgtggcaaataattcaccgcactttgaaattatctggcttcaatttagtggtttcacaggtatcagtcatttttccatttattattcaggcagcccgttatttttccggacagattaaattaggtgatttaattcagacgtcacaggcttttagcaaggttcagtcagcattatcgttttatcgaaactcctatgatgattttgctgcctatcgagcggttctggatcgtctaacaggtttccatagtgctattgaagcagctaatcagccatcaaaaacacaaattaaacctcatatgtcagcggttatttttgagaatttaaatattaatacaccggaaggaaatactctcattgagaagctgaacttaacaattgagcaaggggtttctttattgattaaaggtaaatcgggtgtagggaaaacaactttattgcgtacaacagcaggtttatggccgtattcagaagggcagattttttgtccacaacaaacattgtttctagcacaaaaaacctatttaccacaggggtgcttaattgatgctctttattatcctgaaccggttccggccgacattgacgcagacaatatcagtaacattttgcaaaaagtgcatttgtctcatctggttgacaaattggatgtagaaaatgattggacgagagtactatctttaggggaacagcaacgtgtagcttgtgccagagtattgttgcataagcctaaagttgttttcttagatgaggctacatcaagcatggatgaagggcttgaagatgcgatgtatcgcttattattaactgaattacctagtacaactttaatcagcgtgggacatcgttcaactttgcataagtatcatcaattacacttgcagatcaatagtgataaaagttgggacatgatgaaacatacagaaacattttagcgtaaaacatatttgttaatttgctgaatgaaatgtatccattgatgttaagtcgatggatttttttacgttctaaatttgacatagatcaaataaactttatttttatttgcaaagcattctcaataaaaatgagtttttttactagaaaaatgaatgattaagcaggtttttcttacaaaatttatgcaaataacacacaatatatagtggttgagtttttaaaagtaacaatatatagtgatttgacttttcttaaacgcaacatataggtttatgtaaaaatgggttcattcttcgttattaaacgtgatggttcacgtgcagaatttgaaatacaaagaattattaatgctattaaaaaagctgcaagtgcggtcaatatccaagatgaaatgttctgtcataaaattggacaactggtctgtgataatatttttgctcactaccaaaaagaaattgatattagccacattcaggagattgttgaaaatcatctgatggctagcaagtatccacaagttgcacgagcttatattgaatatcgtcatgagcgtgatttagctagagagaaacgtagtaatttgactaaagaaatcgaaggattaattgggcaaagtaatgtggaattgttaaatgagaatgccaataaagattcgaaagtcattccaactcagcgtgatttattggcgggtattgtcgctaaacattatgctaaacgttacattctgccaaaagatgtcgttgattcccatgaaaaaggcgaaattcattatcatgatttagattatgcaccattctttcctatgtttaactgcatgctggtcgatttaaaaggtatgctgacgaaaggatttaaaatggggaatgcggacattgagccgccaaaatctattggtactgcgactgcggttaccgcacaaattatcgctcaagtagcaagtcatatttatgggggcaccacggttaatcgtattgatgaagtacttgcaccttatgtgcaactcagctatgaaaaacacttgaaaacagctgcactttggcaaattccagatcccaaagcttatgccgacagtttaattcaaaaagaatgttttgatgcttttcaatcgttggaatatgaagtcaacactctgcatactgccaatggacaaacgccatttgttacttttgggttcggtttggggatcagttggcaagagcggttgattcagaaagctattttgcaaaaccgaattcgtggattggggaaaaatcataaaacacctgtttttcctaagttggtttttacaattaaaaaaggggtcaatcaaaattcaggagatccgaattatgatattaaacagctcgctttagaatgtgcttcaaaacgcatgtatccggatattctcaattatgatcaagttgtgaaagtaacaggttcatttaaagcaccaatgggatgccgtagttttcttggtgcttatgaagaaaataacgaattggtccatgatggacggaataatttgggtgtagttagcctaaatttgccacgtattgcactggaagcgaaaggagatgaacagcaattctatacattgcttgaagcaaggttggatcttgctaaaaaagcattgatgacacgtattgcccgtttggaaaatacaaaagcacgagttgcaccaattttatatatggagggagcttgtggtgttcgtttaaaagcagatgataatgtggcacaaatttttaaaaacggtagagcatcaatttcgcttggttatattggtattcatgaaactattaacgccctatttggcggtaaacacatttatgatgatacaaaattgcgtaaaaagggcattgaaattgtcagtttcttgagcgaaaaagttaaacattggaaagcggaaactggctatgcttttagtttatattccacaccgagcgaaaacttgtgtgatcgtttttgtcgtttagataccaaacagtttggtgttgttgatggggtgacggacaaaggttattacacaaatagctatcatttagatgttgagaaaaaagtaaatccttatgataaattggattttgagatgccttaccctcgtttagcgagcggtggatttatttgctatggtgaatatccaaatattcagcataatttaaaagcacttgaagatgtttgggactattcttatgaacgagttccttattatggtactaatacaccgattgatgaatgctatgaatgtggttttacaggagagtttagttgtacaagcaaagggtttacttgccctaagtgcggtaatcatgatagtgaaaaagtctctgtaacccgtcgagtatgcggttatttaggaagcccggatgcacgtccgtttaatgctggaaaacaagaagaggttaaacgccgtgttaaacatttataaaaatcatcgctctttatgaattatctgcaatattatccgattgatgttgtaaatggcgaaggtacaagatgtactttgtttgtcagtggttgttcccatgcttgcaaagggtgttacaaccaaaagagttggtcatttagggctggagtattatttgatcgagagatggaagatcaaattattcgagatctacaggatagacgcattcgccgacaaggattgagtttaacaggtggtgatcctttacatcctcaaaatattaccgcacttttgccttttgtgcagagagtaaaaaaggaatgtcctgataaagatatttggctatggacaggttatttattagcggagcttgatgaattgcaacggaaaatgttgccttacattgatgtgttaattgatggtaagtttgagcaagaaaaagccgatccaagtttgatttggcgaggatccgccaatcaagtaatttatcgttttaagctttagcttttacacaagtccttgcataagcatactcatacgaatggtgcggtatatttaaactctatattgaatttgtataaccaacgtcaatttagatcgttattacgatatagaatatatcagcaaatcgaatattataaaaaaaccgctcctaaagagcggtttttttgcgaaggttttaaatcgggtagccaagttgtattactacaacttagccccctaagaactgtacaagcaaatttctctgcatacagctcaagcctttctattaactgctacgcagtcggtttcgcaacgttcaaattcaggcgatgaatttgttggtgacactcaggatgtactaaacatctgttatttagtgaatctgttccaccatacattttgtaaattatatgatgatcgtgccagccgctttctttcgttattgacgtattacacaatgcacattttcctttctgctctttgtaaagagcttgccattgctgtctgtgtgattgttcatcatacattctggcttgagcaaggttttctccatacatttcccattcaggtaaaaatggtttgtattgtgattttatctttctgtgtcgcttaattttcacatatccacaatagagtaaatttattgggatttgttcttctttattgctgttggtgactgtgccgaaaatccaattccgagttgcatttgaataaaagtatttctctttaatccaaatttttcctttgtttggatgtcttcgtctgcaccaacgccataaggctttccaaattaaactatccattcggttaaatatcactttagccacaacgtgtttatgatagtttgtccaacctcttatcattggatttaatacttttattaggtcatcttgtttcgccattttcatttttgaaattgattgttttaccttgtcgtaaaatgcttttgcatttttcttacttggtttaataatcaattttttatcaaaacgtttaacagtccaacctaaaaagtcaaatccgtgttcgatatgcactaccttggttttactttccgataaggaaagccctctttctgcaagaaagtttttcaccatagggataacttgttcttccagtaattcttttgatatacctgaaataataaagtcatctgcatacctaacgaggtatgtccgatgttttgctattttaagactattctttgcaccaaagtgcttgattagctctttttctaacccatctaacgccatatttgccaacgttggagagataataccaccttgcggtgtcccctccgttgttggttttagttgaccgaactcaacaacacctgattttaaccatttcttgagtattcgcttattcattggaatatgcttgagtagacagtcgtggttaataaaatcaaaacaaccatgtatatctgcatccagtacccattctgccatttgacgagattggtttccttttgttgaaaatatactatgtatatgtgatatagcatctgccgttgaacggtttaatctaaatccatacgaattattgtctgctgttgtttctgctatgggttgcaatgctagtaaatacaacatttgcattgctctatctttcatcgtgggtatgcctaatggacgtttcttcccatttgactttggaatgaaaacccgtcttaatggtttaggttgataccctttacttgatagatcttgtatagcaatccatttggattcaggtgtatcccaaatccgtttatcaataccagcggttcgtttgcctgtattttccgtcacccgtcgtactgctaatgcttttgcataaaacgagtgggtaagcattcgttgtaagtttttaaccttacgccaattgctttcctgtgttgccttcgcaatccgcacctgcattcctttcacatatcggtttgctttataccaattgatataatgccattgcgatatatgtgaggtcgctggagctagactgcttactaatttcttagtatgatgagtttgctctttcatacttacctccgttgagagataagttttcttggtaaattaatcgttcctctttctgtttggacacttcaagagttgctatggttaccaataaacttacactcttgaatcactaaggataaagagtgcgtgcgttggttttatttgattggttttcaatctgcaagccaacgctcgcttttatcccgtcaaattttaaaggaatttgtcagacatcttgcgatgaaagaccggttagaagtctgcaccctttcgggttaggtcatatttcataccctatttgcaccattacagtacaaccttcgctttctctaacttcttttacctacaccaccaacagcattgcttacgcgttgcctgccatttttcaggcggagatataggcttaccaagttccattattactacatggatagggaagatatagtcttttttcccgacagtgtttatgatgacgtatcccaaggctaaaatgagataacccactgcataccttttggttcaagccgatagcgaccgtaggcttgttctacataacgagaattacgactattcacttacgtttatctttctatccaacctagtccctcaacccaatggtcgtttcgagtctcttattaatacttcacagtattaataaccttatcgggggtacattgtcaggaagctccgcacaaaatcgttgccaattatgcactatccctaggttactgttagtcatataacaggttacactcatttatttcttcgcaactgcatatatcaacgttgaaacaaattgtaacaatagtaataacagcttactcatacttaactaagttgttacctaatacagcaataaataagcccttgctggtttgctttaaaacttactttatccattaaacaaatgtttaatagtactttratagtactttgtttacgtttaatcctctaataggaaataactaacctttaacaaataaaaactcatttgttagtaatgattatttcaatgaaaggggatttgggtaaattttagaccgagaagtagcagtgctgttccgcaagccattcacgggcaactattactttcaagttgctgagggtgtttcttaataaaagaatatcccgaagtacagtaaataaagataagtgtaaaggtggcaaccaaatagaagaaattccactttcttatactcgaaccgtttcagattgctacggtatctttcggactttatttatagtaggggtgaataatcattctttatggacgatatgacgttttggatttgacccaagtcactctataaataggcgactaacggtagtcctatctttcgataacggatcttgcttgcttactcctcttaatatttatctaaatattaagtacataaaagtgaagaccataccttattaccgcataaagttggagatattcttaccaacttagaactagatcttgagcaacgctccttttctagtctgctacccaaactcttcccgagaagatctggatagtcaagagaaagctacattacatagctttctcttaattgagttaaatccttgatatataaggacttaaccccagtaagcacaacacttgtcgcacttagcctttgtagttatgtacatgagcaactaaatctaatactttatttgagtagccagtttcattatcataccaagaaactaatttaacgaaagtatcagttaatgcaatacctgctgccgcatcgaatacagaagtcaagctacaaccgttgaaatcagtagaaactacagcgtcttcagtataacctaatacacctttcatttcattttcagaagcacgtttgatttctgcacagatttctgcataagttgccggtttttccaagtttacagttaaatcaacgacggaaacgtttggtgtaggaacacggaatgccatacctgttaatttaccattcaatgcagggataactttaccaacagcttttgccgcacctgttgaagaagggataatattttgtgccgcaccacgacctccacgccagtcttttgcagaagggccatcaacagttttttgggttgctgttgttgcatgaactgttgtcattaaaccgtctttgataccgaatttgtcattgataactttagctaacggtgctaaacagtttgttgtacaagaagcattagaaacaatgtcttgaccggcatacgcatcaaagtttacgccgttaacaaacattggcgttgcatctttagatggaccggttaaaacaacttttttcgtacctgcggtaatatgtttacgagcagttgcgtcatctaagaataaacctgtcgcttcaacagcaacatcaacaccgagctcattccattttaaattagcagggtcacgctctgatgtaacacgaatcgctttaccattaaccactaagtttccatctttgacttcaactgtaccatcaaaacgaccatgagttgaatcatatttaagcatataagccatatattcaacatcaattagatcgttaataccaactacctcaatgtcatcacgagtttgtgctgcacgaaatacgatacgaccgatacgaccgaaaccattaataccaattttaattgtcataatattttcacctataatattttaagttaaacgaaactcgatgctttacagaagtgcttagtctttctagttttcaggctggggtagattatagcataaattcttctttgattatagtgtctctagagtaaatccggcatatatagattttttatgatccacgtcaaagttgataatgtttgtaccacattgattttttagtgtagtatgtgcggagatttatgtttcatcgttacgcggaaaatgacttttcatatggaaataggaagaatatcatgttaaccaaccaaccaaccaaccaaccaaccaaccaaccaaccaaccaaccaaccaaccaaccaaccaaccaaccaaccaaccaaccaaccaaccaaccaaccaaatgaacgtttattttccatagtaaaggaagtttttccgaaaagtcatagcataaatttttctcttttaggaggaatgaccaacaagaattatctcctttatgttgataatgaaaaatatgtattgcgtctgccaggggtaatgacatcgaatttgatttcaaggcactatgaaatgaataatagtatattgatgtctcaggcagaatttaatgttgaaacaatttattttaatgctgataatggtattaaaataacgaagtttttagaaaaaggtatcaattttaatcataataatattcatcaatatgaatatttatttctcatctcaaaagaattatataaattacatcattcagatattcaatttaataatgaatttaatgtatttgaaacttttcaacaatattttgacttattaaaagataagaatggatttttctgctttaataaaaatattccattgatatacgaattttttattaaaatttcaaagaataattctttttataacatcaaatgtccttgccataatgatcttgttcctgagaatattttaatgaaaaacaataaattattttttattgattgggaatattcaggaatgaatgctccgttatttgatgtagcggctttttttcttgagtcgagaataccagaagaaaaacaaaaatatttccttgttcattatgatcatcatctggattttgaaaagtctcgtatggaaatactatttcatcaatttacccaagatgttttatggtttttatggactttgataaaagaagaaaataatgagaaatttgaaaattatgcctcaacaagaataaatcgtgcttatgaactgatgaaggagttggtgaaaaatgggtttatttagtgaagataaacgattagttcatgtcggttatttttgtggattattatccggtttattttgggcaatatcaggaatttcttacgaaaaattatatctagatttcccaatgctgaatgcgtttgcattaaatattattatattaagtattgctgagattactttgctgttaatggcttatggttatttgataaaaagaaaattattaccgcactttaataaggtttctttgttagcgattttgggaggttgtttgggtggtcctgttgggatgatttgctatttacagtccttacaatatgttggagtgagttatgcggcgacgatttcaatttgttatccaattatagcatctattttatccatcaagtttttagctgtgaaagcatcaagaagaacactattttcttttgtttttattgtcttattattaatgcctatcatgtatcaaggtgaaaattcagaaatcaggattttaggcattatttttgctttttcttgtgcattatgttgggcacttgaaattgtgatttccagttatgtcatgcaacactatccatccgatcaagtttatttatttagacaaataggatcgtctttaggatattttcttattattcttttcatgtttttttatggaacttatgacaatttaattgattttaatttttttaaggatgtaaatctatggaaattggagtggatagttattatttcctcaggattttcttattttctatattataaatcaattgcaattttgaatccaattagagcaatggcattaaatattacatatagtctttgggcgattgtattaagtgcggttcttttatcaaaggaaattagtatctttctgcttatgattggaataattgtattgatgaatatttttattgtggcgaaaggagaagaaaaatgaatgccattattttagctgcagggttaggaagtcgttttagagagattacgcagaagaagcataaggctttacttccgttacctaatggaattcctaatattgagcaaacaattatttatttaaagcaagcaggtattcatgaaattcatattgtaacaggttattttgctgagcagtttgattttttaagcagtaaatacggggttaatcttatttataataatttttataaaaattacaataatatctattctttttattgtgctattgattatttcggagaaagttttgttattgatagcgatgtgacactttttagcaatatttttaatgatacattaaaacgaagtcaatattttttgattcaaaggaataaaagtcataataaagaatggattccgattgtgaaagataataaagttattgatattattattgacagtttggagttgccgagtttactgggtgtctctttttggtcaaatcatgatgcggtcaaaataaaatcatttctggctgattatgtgaataatgaaaatttattacttgattcatcattgtattgggataatattccaatggaaaatcttaaagaattggatattggtgtaaagcttttgaatataaaggaagcttatgaaatagataatttatccgagtatgactttatatttcatcatttaaaaggtaaatagtatgaaaaaattatcattgagagaacttcaattggcatcattagatattttgaaatattttgatcaattatgtgctaaaaatgatattcaatattccttaggtggaggtacattaataggcgcggtaagacataaaggatttattccatgggatgatgatattgatgtctatatgcagcgtgatcagtatgaaaaattcgttaatgtttggaaaagtgagacgcatgctcaatatgaattgtctttagcggaggatattcatggtatgtttccgggtgagatgacaaaaatttttgataaaaatactgtacttatagatacgaaaggaagaaaaagtggcatatttatagatatttttatttatgatggtgtgccaaatgacccggcggtgatttataaagtgatgaagaaacatcgtcgccttaaattgaggttttcatcttgtcgtaagagatggtataaagctaataatgagagtttaattcagtctatattttttagattatcccagtatttatttaataagatgatgttaaatttaaaacaatttcaagacaaatatcctattgataaggctgaatatataggacttgttttatcagattacggtggctggaagaagtcttatatgcctaaaaaatattttaactccgttgtttatttggattttgaagagagtaagtttcctgttatgaacggttatcatgaacatttgaccatgtattatggtgattatatggaactgcctcctgttagtgaacagaaacctcaacacacgattgaagcttatatattagattaggcaatctatttcttttttattaaaaatcagcaaaagagcggtcattttgctgatttttttttgatttatcggcataataggtgctataaaaattttatgggagtcattatgtgtaggggaaatttatatattatttctgccccaagtggagcagggaaatcttctttgatttcagcattattggaacgggataaaaacgatagtatgacggtgtccatatcacatacaacaagatccccaagaccgggtgaaattgatggggtgcattatcactttgtttcacatgaaaaatttgaacagcttattttcgaaaactcatttttagaatatgcgaaagtattcggtgggaattattatggtacgtcattactgaatattgagaaaaatttagcggcaggtatagatgtattcttggatattgattggcagggggcaagacaaattcgagaaaaacgtcctgatgttaaaagtatttttattttgcctccttctatttctgctttagagaagcgtttgattgggcgtggtcaagatagtcaagacattattgcaaagagaatggaaaaggcagcggatgaaatctcccattatgatgaatatgattatgtcattattaatgctgattttgatcaagcattagtagatttagaacatattttgcgagctgaacgattgactgtaaattatcaaaaaacgcaaaatgcggctttaattcatcaattactagtaaaataattttggttttagtatcatgggagcgttttttgtgaatacattaatggagaaattatggctcgagtaacagtacaagatgcggtagaaaaagtaggtaatcgttttgatttaattttaactgcggctcgccgtgcgagagaattgcaattacataagcgtgaacctttagtgccggaagataatgataaaccgacagtcattgcgttgcgtgaaattgagaaaggattaattaataacgatattatgaacgctcatgagcgtcgtgaggcattagaacaagaaactgctgaattgaatacaatatcgctgttatatcaaaataattaagtaaagtgcggttcttttttgtaaactttatcaagtacatttcaatcttttttgcatattaatcaatagtcaggtgtcttttgtatttatttgagagtttagagaaaattatcagaggatatttgtctccgtcacaaattgagttagttcggcatgcttttgttattgcaagagatgctcacgaaggacaagcgagggctagtggcgaaccttatattactcatccggttgccgttgcttctattattgcagaaatgcatttggatcatgaagcagtggttgcagcgttattgcatgatgtaattgaggatacgccttatactgaagagcaattaaaagaagagtttggtgcgagtgttgctgaaattgtggagggtgtttcgaaattagataaattgaaatttcgtacacgtaaagaagcggaagtagagaattttcgcaaaatgattttggcaatgacaaaggatattcgtgttgtgttgattaagctagccgaccgtactcataatatgcgtacactgggtgctttaagaccggagaaacgccgtcggattgcgaaagaaaccctagaaatttatgctcctttagctcatcgtttagggatagagcacattaaaaatgaattagaagatttaggttttgaagcaatgtaccctcaacgttatgcggtattgcgaaaagtgattcaaattgctcgtggtaatcgtaaggatatgattgagtgtatcgcttcagatattaaaggacgcttgacggaggctggcattacggcacgagtatttggtcgtgaaaaacatctttatgctatttaccaaaaaatgcgattgaaagatcagcagtttcattccattatggatatttatgctttccggacggtggtaaaggatgtggatacttgctatcgagtacttggtcaaatgcacagtttgtataagccgcgtccgggacgggtgaaggactatattgctgtacctaaagccaatggttatcaatctttgcatacatctatgattggaccacacggtgtacctgtcgaagtacaaattcgtacggaagaaatggatcgtatggctgaaatgggtgtggcagcacattgggcatataagcaatcaggacgaaatgacagcacaacggcacaaattcgagctcagcgttggttgcgaagtcttgtggaattacagcaaagtgttggtaattcttttgagtttattgaaagcgtaaaatcagagttctttcctaaagaaatctatgtatttacccctaaaggacgtattattgagttgcctaaaggtgcaactgcggtcgatttcgcttatgcggtacatacagatgttggacatcattgcgtggcagctactgttgatcgtaaaccttatccgctttcctttgcattacaatcaggtcaaacgattgatattagtatcgatgaaaattcaaaaccaaattcggggtggctaaattttgttgtgacagcgaaagctcgaacaagtattcgccaagcattgaaatcgttaggtgctgatgatgctgttaatttaggcaaacgccaattactgcaggcacttttacctaaaaaacttagtgatattccaccgcacattgtgcaagaagttttagatgatttgaaattaacgagttttaatgacttgctgatggaaattggtttaggaaatcagattagtggagcaattgcttatcgattggtgggtgagccattgaaaattgatacggatggtaatcctaaaaataatacggaattattgcaaattaagagctctgaaggtttatcaacaacctttgggcaatgttgtcatcctattccgagagatccaattgtggcttatacgagttcagggaaagggcttgttattcatcataaggattgtgctaatttgaaaaaacgtaaagagaatactgaacattatatgcaggtacaatgggaggatgaagatacctcgattgagtttgaaactgagttgcgtattgaattactgaaccaacagggtgctttacctcatttaatgtcaatgatttcttctttggatagccgcattcatagcatttggacggaagagcaagacggtcgcctttaccaaattgttattttattaaccgtgaagaacacagaacatttggagcaaattatgcgtaagattaaaagtgttcctggctttttatctgtcaaacgcaacattaataattaatgggtggacaattcttagacgctattccacttacttctttgtcgggtgtcggtgccgcaatagcagaaaaattaggtagaattgggctttttagcctgcaagatcttctgtttcatttgcctattcgttatgaagatcgtacccgtattacccctattattgatcttcgtattgatcaacatgcgacaattgaaggaatagtacaaacttgtgatattcaatttggtcgtcgtccagttcttgtggtgacgctttctgacggtactgccaaaattgccttacgcttttttaattttaatgcaggtatgaaaaatggctttcagcttggagcgagggtgaaagcctttggggaaattaagcgtggtcgatttatggctgaaattcatcaccctgagtatgaaattattcgtgataatagacctcttcagttagcagaaacgctcaccccaatttatgcgacaacggaaggcttgaagcaaaatacattacgaaagttgactgagcaggcattagtgttgctagaaaaaatgccattagcggaattattgcctagagcttttaatcctcatgattttagtttaaaacaggccatttacgttttacatcgcccaccacccaatatttctttggaattgttggagcaaggaaaacaccctgcacagttacgtttaatttttgaagaattattagcacataatcttgctatgcaaaaagtgcggtgcggatctcaacatttttcagctttacccttacgttatcaaacagcattgaagcaaaattttcttgatttattgccatatcaaccgacaaatgcacaacaaagagttgttgctgaaattgaatatgatctgggacgttctttcccaatgatgcgtttggtacaaggcgatgttggctccggtaaaactttagttgttgctttagctgcattaattgctattgataacggtaaacaggtagcactcatggcaccgactgaaattttggcagagcaacatactgcaaatttccaacattggtttgaaccgttaggaataaaagtgggttgtttgacaggaaaagtaaaaggcaaatctcgtcaagctacattggaggagatatcccaaggcaatatacaaatggttgttggtactcatgccttgtttcaagatgatgtcaagtttgccgaactggtattagttgttattgatgaacaacatcgctttggtgtacatcaacgcctgatgttgcgtgaaaaaggaaagtatgccggtatttatccacatcaattaattatgactgcaacacctattcctcgtacattggcaatggtagcctatgcagatttagatacttcaattattgatgagttacctccgggaagaacaccaattcaaactattgcggtatctgaagaacgcagaaccgaaatcgtcgctagggtgtataatgcttgtgttaatgaaaaacgccaagcgtattgggtttgtactttgattgatgaaagtgaagtattagaagcccaagcagcagaaagtattgcagaggatctacaaaaagccttgccggtactacggattggtttgatacatggcagaatgaaagtgagtgaaaagcaagaagtaatgaggcaatttaaaaatgctgaattgaatttgttggttgctacaacagtaattgaagtcggggttgatgtacctaatgcgagtttaatgattattgaaaatgcggaacgattaggtttggcacaattacatcaattgcgtggtcgggttgggcgtggtagtacggcatcctattgtgttttaatgtataaatcacctttgagtaaagtgtcgagaaaacgtttagaagtaatgcgttcaagtcaagatggcttctttatttctgagcaagatttagaaattcgtggaccgggagaagttttaggtaccaaacagacgggtgttgcagagtttaaagtggctgatttaatacgagatcgtaaaatgctgcctactgttcaacattatgcccgtctattaattacacgatctccaaagttagcagatgacctcattcagcgttggcttaaacataaagaaatttataccaatgcgtaagtgaacatttaacttttgtggaactgagaattatataagtaaagagcggtcaatttttaggaaaattttatgaggttctcaatacaaccaacaattttattttttgattcaggtgtaggtgggttgagtgtttataaagaaactaaacaacttttaccggattgtcattatttatattgttttgataacggattttttccttattcagaaaaggacgaaaaagatattattgaccgcactttaagaatttgtcagaaaatcaatcaaacttatcccttagatttaattgtaattgcttgtaatacggcaagtacggttgttttgcctgaattacgccggaatttttctattcccatcgtgggaaccgtacctgcgatcaagcctgctgcagaaatgtcagaaacaaaacatattggtttgattgcgacgaaaggaactataaaaagaacttatgttaatgatttgattgaaaattatgcacatcattgcatggtggaaaaaattggtagcactaagttggtagagattgcggagcaaaaattacgaggcggtgaagttgatcttaatgtcctaaaacaagaacttagtccatggaaaactatgaaatcacttgattctgttgtattggggtgtacacattttcctctaatcaaagaggaaatagaatgctgtttaccgcaggtaaaattttttgtgagttctggtaaggcaattgcgaaacgggttaaatttttattaaaaggtatagaagtgcggtcaaaaattcagaaaaaaaatttgattttttgtactaaacctcttgaagatgataagtctgttcaacaaattttagattttggggaatttgagaatttagtgatattgtctgattgagaccaagcaactagacaaaaataaaacttgtattttgtaattgaatagatttttactcagataaatgtaggaaaattgagcaaatagtttttattttagacaaaggagaatatttttaaaaaaaattataaaaaaagcttgcattgaaatataaaatgcctataatgcacggcacacaacgacacgctgttgtgagaggttaagcagtgtgtcgttattttttgttctttaacaaactatcagacaaactgtgtgggcacttgtgagactgtattaataagagattaaaagagtaagataagtgcttaaactagagaaattcatagagaaaagatggatgaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggaccaaaggggtgggactgagaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtgatgaggaaggcgattagtttaagagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctgggtagctaaatgcgggagagataagtgctgaaagcatctaagcacgaaacttgccttaagatgagttctccctaatgaagagttagtaagggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaagacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgagtttattttgttagtttatttatattagtaaactaacaaaataaattttggcagtcatagtgcaatggaaccacctaactccttgccgaacttagaagtgaaacgttgttacgccgatggtagtgtggggattccccatgtgagagtaggtcactgccaaatatcaaatttagcggagtggtagttcagctggttagaatacctgcctgtcacgcagggggtcgcgggttcgagtcccgtccattccgccaatttatatctgtttaggggcgtagttcaattggtagagcaccggtctccaaaaccgggtgttgggagttcgatcctctccgcccctgccatgttttccttagtcatatatttcattaaaatttttcatctcatatcttttcatagtttcaaaaatgcaatattctattacaagacgaagaatatgcagcagttaatagaaattttggtggcattttcttatcaaaaaactcagtaaaatctatgtggagacaattgtgggaaataaaatcttaaaagggatttttttgctctatccgccgctgcgttgaatagtagtattggaatttttagcaaaaatttattagagcagaacctaaatattcaatctattgccttttttaaaacaattatcgcttttgctatgatcagtctggtgttaagtcgctcatcatggcaagaacagaaaaatcaagtaaaaccttttgcaaaaaatacagtgaacctacttttccaaatagctatttgcgcatttctggggattttaccttatttttctttgaaaccactgcttatcagtatggccatgccgctaatgtggtagtcgtactaatgaccactgctgccgtatcctccctgctcgtagggctatattattgtcagagccattgaaggtttccgccattgctggcacttgttttgccgtatttggcgtatttatcatttcttggtcgggctctagtcaatggctatctattctatatgccattcttgcaggtagtggctacggtttattttccgtactcatcaaaaaatttaatttaaatggtggcataccattaacacgattattgatgatgtttggagcgctatatttgttctatccatttgtcacacattttcaacatatagaaatccagtggaatacgactgttatactcaatcttgttgcacttgctttactacccacgctgattggtttttactgcacaaccaaggcgttagtttatctcagtgcatcgaaagtacaggtaactgaactgtcagaacctatcttcactatggtactggcatggttactactcaatgaagttccaaatcaaactttctttttaggtgcgttttgtattgtgttaggcattgcgttgatcaatcaaatgttgcaattcaaaaagtgagaagtgagttctaacaggttatgtacgctatgtgtagggtattttgatgggtatgagttttatatttaatcgatacgatttttaggcgagctgaaaactcatttttatacttacttacttcctttcttttctacaaatttaattattttttgtattatttaaataaattaattgagtgatttcaaaaaataagtatgatagccggagttttttgtttatctcttttagggagcttttatgctttatttggaatttttatttttacttttaatgctttatgtaggaagtcgctatggcggtattggattaggtgttgtatccggtattggcttagctatagaggtctttatcttccgtatgccagtaggtaaggcaccaattgatgttatgctaattatccttgctgttgtgacttgtgcatcggtacttgaggctgcgggcggtttgaaatttatgctacaaatggctgaacgtgtattacgtagcaatcctaagcgtgtaactatccttggacctttagtaacatattttatgacatttatgctcggtacagggcattctgtttactctattatgccaattattggtgatgtagcactaaaaaataatattcgtccggaacgacctatggctgcagcatctgttgcatctcaacttgcaattacatctagtccattatcagcggctgttgttttttatcttgggaaaatcaccgcacttccaggatttgagcatattaccttattagatattatttgtgttactgtacctgcgacattggcaggaactattgcattgtcactttatagtttacgccgtggtaaagagcttgaagatgacaaggaatatcaacgtcgtttacaggatcctatttggcgtgagcgtattttaaatacaactagtacaactttaaatgaagtattaccgccagcagctaagcagtcggtatatttatttttactctcgttagttgtgattgtaatgatcgcaatgtttcctgaaattcgtactatcggtagtgcttctaaacctatttcaatgtcattaattattcaaatgatgatgctatgttttggcggtattaccttgttggttacaaaaactaatccacaaattgtaccgaacggtgttgtatttaaatcaggaatggttgcagcaattgctatttttggtattgcctggatgagtgacacttattttcagtatgcaatgccacaatttaaggcaggtattgtagatatggtgaaagcctatccatggacttttgctttggcactatttgctgtttcagttgttattaatagccaagcagcaacagcggttatgatgttacctgttggaattgaattaggtttatctccagcattattagttggtctgatggcggcaacatatgcttatttctttattcctaattatccatcagatattgcaacggtgaactttgatgtgacaggtacaacgaaaattggtaaatattactttaaccatagctttatggctccaggtttaataggcgtttttacggcttgtgtggttggctacctcattgcacaagttgttattcgttaagttcatcaaataaaaagtgcggtttaaaaccgcactcataccgttaacagtttgatacgagagatattccgtaaaaagcaacatcactcagcattgtgaggtaacttttttgctttggttgtttgctaatttgtacttcacgtaattctttgacatgggcatagagatgtttttagaataaaacctcattcaatcgtcaaatgtatcttgctaaaaactatttggaatgatagaatctcaagccattttagtaaattgctgatagttttatactctcagcaatttacattttttaaatacaccgtttgattgcaaaagagttaggctaaatcaaactattagcttaatgcaatccgcacatcagaagtaaggttcagagggcggtacctagcaaacgggttcaagcattgatataaaatttattataaaatcgaccgcactttatgttgtcgaactgaattttatattgaatcggtctcactaatatttacagaggaacccaaatggtttactcctataccgaaaaaaagcgtattcgtaaaagcttcggcaaacgtccgcaagttttaaatgtaccttatttattaacaattcaacttgactcttttgataaatttatccaaagagatcctgacggtcaacaaggtttagaagctgcattccgttctatatttcctattgtcagtaacaatggtaatacagaattgcagtatgtcagttatcaattaggagaacctgtttttgatgtaagagaatgtcaaattcgaggtactacttatgctgcatcattacgtgtaaaattacgccttgttagctacgataaagatgcggcatccggcacgataaaagacataaaagaacaagaagtttatatgggagaaatcccattgatgaccagtaatggtacttttgtcatcaatggtactgagcgtgttgttgtatcacaattacatcggagtccaggtgtattttttgatagtgacaaaggaaaaacccattcatcaggcaaagtactttataatgcacgaattattccttatcgtggttcatggttggattttgaatttgatccgaaagataatttatatgctcgtattgaccgtcgtcgtaaattaccggctactattattttacgtgcattaaattacactaccgaagaaattttggatttattctttgataaggtttcgtttgagatcaaagataataaattactaatgactttagttcctgaaagattgcgaggtgaaaccgcatcttttgatattgaagcgaatggtaaagtgtatattgagcgtggtcgccgtattaccgctcgtcatattaaagcattagaaaaagataagattacacaagttgaagtaccgacagaatatatcgtaggtaaagtttcagctaaagattatgttgatttaacaacaggtgagattatttgtccggcaaatatggaaatttcgttagaattgttagagaaattatcacaagccggttataaaaatattgaaacgttatttaccaacgacctagattttggtccgtacatatctgaaacattacgtgttgatccatcctatgatcgtctaagtgcattagttgaaatttatcgtatgatgcgtccgggggagccaccaacaaaagaggcggcagaaggtttatttgataacttatttttctcttccgaacgttatgatttgtcagctgtaggtcgcatgaaattcaaccgctctttgggcattgaagacactacaggtagcggtacattgagcaaagaagatattgttaatgtaatgcgtaaattgattgacattcgtaatgggcgtggtgaagtagatgatattgaccacttaggtaatcgtcgtattcgttcagtgggtgaaatggctgaaaatcaattccgcattggtttagtccgtgtagaaagagcggtaaaagaacgtctttctttgggcgatttagagtcggttacaccacaagatttaattaatgctaaacctatttcagcagcagtaaaagagttctttggctcttcacaactttctcaattcatggatcaaaacaatccgttatcagaagttactcataaacgtcgtatttctgcattaggtccgggtggtttaacacgtgaacgtgccggctttgaggttcgagatgttcatgcaacgcactatggtcgagtttgtccaattgaaacccctgaggggccaaacattggtttgattaactcgctatctgtttatgcacgtactaatgattatggtttcttagaaacaccatatcgtaaggtagtaaacggtcaagtcacagaagaaattgaatatttatctgcgattgaagaaggaaaatatgttattgctcaggcaaactcaaaccttgacaatgagcttcgttttaccgatgctttcgtaacctgtcgtggtgagcatggtgagtccggattatatcgaccggaagaaattcattatatggatgtttctactcaacaagtagtgtctgttgcagcagcattaattccttttcttgaacatgacgatgcaaaccgtgcattaatgggtgcaaacatgcaacgtcaagcagttccaaccttacgtgctgataaaccgttggtgggaacaggaatggaaaaacctgtagcactggactccggtgtagcggtggtggcaaaacgtggaggtactatccaatatgttgatgcttctcgtattgttgtaaaagtcaatgaagatgaaactattgcgggtgaagcggggattgatatttacaacttaattaaatatacccgttcaaaccagaatacttgtattaaccaaattccttgtgtgcaattgggagaaccgattgaacgtggtgaaatcttagctgatggaccatcaacggatctcggagaacttgcacttggtcaaaatatgcgtgtcgcattcatgccttggaatggttataactttgaagactcaatgttagtgtctgagcgtgtggtacaggaagatcgtttcactactattcatattcaagaattatcttgtgtggcacgagatactaaattaggttctgaagaaattaccgccgatattccaaatgtaggtgaagctgcgttaagtaaacttgatgaatcagggattgtttacatcggtgctgaggttaaaggtggagatattcttgtcggtaaagtaacacctaaaggcgaaacccaattaactccggaagaaaaactgctacgtgctatttttggtgaaaaagcatctgatgttaaagactcttccttgcgtgtacctaacggcacatcaggtacagtcattgatgttcaagtcttcactcgtgatggtgttgaaaaagataaacgtgcattagaaattgaagaaatgcaattaaaacaggctaaaaaagatcttgtagaggaattagagattttagaagccggtttgtttgctcgagtacgtaatttacttctttccggtggtttcaatgataaacaattggaaaacttagaccgcactcaatggttagagcagactttagttgatgaagataaacaaaatcaattagagcaacttgctgaacaatacgaagagttacgtaaagatttcgaacataaacttgaaattaagcgtagtaaaattatccaaggtgatgatttagccccgggagtattgaaagttgtcaaagtttatcttgcagtaaaacgtcaaattcaaccaggtgataaaatggcgggtcgtcatggtaacaaaggggtgatctcgaaaattaaccctgttgaagatatgccatacgatgaaaacggtcaacctgttgatattgtcttgaacccgttaggggtaccatcccgtatgaatatcggtcagattttagaaactcatttgggactggcagctaaaggcattggtgatcaaatcaacgcaatgataaaacaaaaacaagatgttgaaaaattacgtggctatatccaaaaagcttatgatttaggagatggttcacaaaaagttgatctttcgacctttactgacgaagaagtattgcgtttagcaaaaaacttgcgtaaaggtatgccattagcaacgccggtatttgacggtgcacatgagaaagaaatcaaagcgttattagaattaggtgggttaccaacttccggtcaaattaccctgtttgatggtcgtacaggtgaaaaatttgaacgtcctgtaacggtaggttatatgtatatgctgaaattgaaccatttagttgatgacaaaatgcatgctcgttcaacaggttcatatagtcttgttactcagcagccacttggtggtaaagcacagtttggtggtcaacgttttggtgagatggaagtatgggcactggaagcatatggtgcagcctatacattacaagaaatgttaacagtgaaatccgatgatgtgaatggtcgtacgaagatgtataaaaacatcgttggaggcacacaccaaatggatccaggtacgccagaatctttcaatgtaatcatgaaggaaattcgttcattaggtatcaacattgatcttgatgaagagtaatgggtaaccacaaaaatacgcccaagtgcggtgggatttataaaagttttaaccgcacttgaataattttaactccgataggagcaaatcgtgaaagacttagttaagtttttaaaagcacaatcaaaaacctctgaagattttgatgttattaaaattggtttagcatcaccggatatgatccgttcttggtcatatggtgaggttaagaagcctgaaacaattaactaccgtacattcaaacctgagcgtgacggtcttttctgtgcccgtatttttggaccggtaaaagattatgagtgtctatgcggaaaatacaagcgtttgaaacaccgtggagtgatttgtgaaaaatgcggtgttgaagtaacacaagccaaagtacgccgtgaacgcatggggcatattgagcttgcctcacctgttgcacatatttggttcttaaaatcattaccgtcccgtattggtttattgttggatatgccactacgtgatattgagcgtgtactttattttgaatcttacattgttattgaaccgggaatgactgatcttgagagaggtcaattattaacggaagaacaattcttagacgcagaagatcgttggcaggatgagtttgatgcaaaaatgggtgcagaagcaattcaagccttgttacgtgatatggatttagaagttgaatgtgaaacattacgtgaagaattgcaatcaacgaattctgaaactaaacgtaagaaaattacaaaacgtttgaaattgttagaatcttttatccagtcaggcaataagccggagtggatggtgatgacagtattacctgttttaccaccggatctacgcccattagtacctcttgacggagggcgttttgcaacatccgatttgaatgatttatatcgtcgtgtaatcaatcgtaacaaccgtttaaaacgcctattagatttaattgcaccggatattatcgttcgtaacgaaaaacgtatgttacaagagtcagttgatgcgttattagataatggtcgtcgtggtcgtgcaatcaccggttcaaatcgtcgtccgctaaaatctcttgcggatatgattaaaggtaagcaaggtcgtttccgtcagaatttattagggaaacgtgttgattactcaggtcgttccgtcattacagttggtccatacttgcacttacatcaatgcggattgccgaaaaaaatggcattggaattattccgtccatttatctacgctaaattagaaagtcgtggctttgcaacgactattaaagctgcgaaaaaaatggttgagcgtgaagatgctattgtttgggatattcttgccgatgttattcgtgaacacccaattttgctcaaccgtgcaccaacattacaccgtttaggtatccaagcatttgagccaattcttattgagggaaaagctattcagttgcacccgctggtttgtgcggcatttaatgctgacttcgatggtgaccaaatggctgtacacgttccattgacattagaagctcaattggaagctcgtgcattgatgatgtccacaaacaacattttatctccggcgaatggtgagccgattattgttccttcacaagacgttgtattaggtctttactatatgacacgtgataaagtcaacggtaaaggcgagggaatgttattacaagattcacgtgaagcagaaaaagcctatcgtacaggtcaagctgaattgcattctcgtgtaaaagtgcgtattactgaatatgttaaaaatgcaattggtgaatttgaacctcaaacacatttagtcgatactacaattggtcgtgcaattttatggatgattgcaccaaaaggcatgccatttagtttattcaaccaaactttaggtaaaaaagcgatttctaaattaatcaacgaaagttatcgtcgtctaggattgaaagagagtgtattgtttgctgaccatattatgtataccggttttgcttatgctgcacgttccggttcatctgttggtattgatgacatggttattcctcagaaaaaatatgaaattatttctgctgcggaagaagaggttgctgaaattcaagaacaattccaatccggtcttgtaacagctggtgaacgctataacaaagtaattgatatttgggctgcggcaaacgaacgtgttgctaaagcgatgatggaaaatctttcgcaagaagaggttatcaatcgtgaagggcagccggaaaaacaagcctcattcaatagcatctttatgatggcagattctggtgctcgtggttctgcggcacagattcgtcagttagcggggatgcgtggtctaatggcacgtccggatggctcaatcattgaaacaccgattacagcaaatttccgtgagggtttaaatgtattacagtactttatttcaacccacggggcacgtaaaggtcttgcggatacagcattaaaaaccgctaactcaggttatctaacccgtcgtttagttgatgttgcacaggacttagtgattatcgaagatgactgtggtacacatgaaggaatcgtaatgactccacttatcgagggtggcgatgtaaaagaagcattacgtgatcgtgtattaggtcgtgtagcggcagaagatattttaaaaccaggcacaaacgaagtgttaatttctcgtaataccttattagatgaaaaactttgtgatgtcattgatgaaaattctgttgatagcatcaaagtgcggtctgttgtaacttgcgatactgattttggtgtgtgtgcaaaatgttacggacgtgatttagcacgtggacatttgattaatcaaggtgaagctgtcggtgttattgccgctcaatcaatcggtgaaccgggtacacagttaaccatgcgtacattccatatcggtggtgcggcatctgctgcggcaaaagaatccagtgttcaagttaaaaataccggtacattacgtttaacaaatgttaaattcgtaacgaataaagaagggaagttagttttaacttcacgtaacactgagttgacaattattgatacattcggaagaacaaaagagcattataaagtaccttatggtgcggtattaaatcatgctgatggtgaagaagttacggcaggtgaaaccgtggctaattgggatcctcatacaatgcctgttatttctgaagtcagtggttttgtgaagtttgtggagattgttgatggactaacggtaactcgccaaaccgatgaattaacagggttatcttcaatcgtagttcaagatgtaggtgaacgtgcaacagcagggaaagatttacgtccggcattaaaactggttgacgctcaaggtaacgatatttttatcccaggcaccgatgttatggcacaatatttcttaccgggtaaagcaattgttagcttagatgatggtgcggaagtctttgttggtgaaccattggctcgtattccacaagagtctgtaggaacaaaagatattaccggtggtcttcctcgtgtagcagatttatttgaggcacgtaaaccaaaagaaccggcaattttagctgaaatttctggtatcgtgtctttcggtaaagaaaccaaaggtaaacgtcgtttgttaattacaccgatggaaggtgaaacatacgaagaaatgattccaaaatggcgtcaattgaacgtatttgaaggtgagttggtgcaacgtggtgatttaatttctgatggtgcggaaacaccacatgatattttacgtttacgtggtgtacatgccgtaacagattatatcgttaatgaagttcaagaagtttaccgcttacaaggggtaaaaattaacgataaacatattgaagttatcgtacgtcaaatgttacgcaaagcgattatcactaatgcttatgactctgaattcttagagggagagcaggtcgaagtcgctagagttaaaattgtcaaccgtaaacgtgccgaggaaggtaagccacttgtagaattcgaacgtgaattattagggattactaaagcgtcgttggcaacggaatcctttatttcagcggcttcgttccaagaaacaactcgtgttctaactgaagcggcagttgcaggtaaacgtgatgaattgcgtggcttaaaagaaaacgtgattgtaggtcgcttaattcctgctggtacaggttttgcatatcaccaaaaccgccaaaaaaatcgattggtaggtggtatggaaaatacgactgaggttaaattatctgcagttgatgaggaagaaattgcttctgaatttaccttttcagcagaagatgcaacagcaaatttggcagagatgctaaatatggcagatgatgcagaataataagtagcttggtacaaaatatttaattttaaaaaccgatatttatgtttgtaaatatcggttttattgtttagataataaagtacatgcaacattattaaaaccgaaaatctgtgtcatattcaatgatcacgactattgttcaaaattttctgtaatatagaggaaacggagaaacttcatttttaaaggatttgctgaaaggtattttgtatgaaaaaagctttcaacagtgtgaaatgcctgctataacttttgtaattttcgtttccgttttatacaatattcagcaacataaatgtcttcaagtaattaaccttaatagtggaacacctcatggaaaaaagcttatcccttattcctaatatcagaatgaaacgagaaggaatgacaaatacggaaaaacgagtagttgactggttattagatgcaactaaatttaataaatccacagcattgaatgctattgcaaatgatcttgacgtatctgaggctttaattgtaaaagttgcaaaattactcggtttctccggttttcgtgatttaagaaaacaaatcactacttcttttgaagaaaatcaattagatacatttgaactttccagtcaagatacgcctcaagatcttgtagataaggtttttaatgtctctttacaaacaatctctgaaggcaaggcgattttaaattccaaagtcatttctgaagctgcaaaatgcttttttaatgctcaaaatagagatctgtatgctgctggtggttcaaatacaatctgcgatgatattgaacataaattcttgcgtatcggaattcgctgtaatacctatcgagatattcatttaatgatgatgtcagcctcattactcactgaaaatgatgtgatcttagtggtttctcattcgggtaaaacaaccgatttgttaaaagctgtctatgaagctaaaaaaaatggagcaaaaattatctgcatcacacatagtgatatttctcctattgctgttatttcggattttgtaatttgtacgcccgcaccagatactccattgctgggaaaaaatgcttcagcaagaattttacaacttattttagttgatgccttctttgtctctgtagctcaacaaaatattcacttatctgaaatgaacttagagaagacatttactgcaacaaaatacttcagaaaaaaatagcttccttccattaaaaaggtccttttttatcattaaaaactttacaatattttaatatttgtgaagttgatcacttttttacccctttcaataaagtataattataaaaaaataaataaaaattataaaaatatgaagtttaatcattttttataatttttagttttctattaacttacataaggagtaatttcatgaaaaggttcaaaacactaaaatcctgtttggctatacttggcttagtttgctctgtttcggtttattctgctgaatatgccgtaatacttaaaacgctttcaaatcctttttgggtagcaatgaaagaagggattgaaaatgaggcaaaagcactgggagtagatgtagatatttttgcttcaccatctgaaggtgattatcaatcacaacttcaattatttgaagatttaatcaataagaattataaaggtatcgcttttgctccactttctcctgcaaatcttgttatgcctgctgccaaagcctatcggaaaggtatttatcttgtgaatttagatgaaaaaatcgatattaaaaatttacaaaaggcaaaaggcaatgtagaggcatttatcacaacagataacgtagctgtaggtggaaaggctgctcaatttatagtagataaattaggttctgaaggaggcgaagttgccattattgaaggaaaagcaggcaatgcttcgggtgaagctcgtcgtcgtggagcaagagaagtttttgttaaaagttcgagcattaaattagttgctagtcaacctgcagattgggatcgtattaaagcactggatgtagcaaccaatgtactatcaagaaatccaaatctaaaagccttttatgtcgcaaatgatacgatggcaatgggggtagcacaagctgttattaatgctgggaaacaaggtaaaattttagttgtgggtaccgatggagttcctgaagcaagaaaaatggttagcgaaagaaaactcactgccactatcgctcaagatccggcaatgattggtgcaaaagggttgaaactgcttgttgatgcagcgagagcaggaaaacaaatacctgttgatgttgagccaaaaattgaaactgttgattcgatattaatttctcaataatacggaagtatgtggggattttaatctccacataggagtgtttttctatggcaatcccattaatacaaatgaaaaatatctcaaaaagttttggtgttgttcgggcattaaaaaatgtcaatcttgatatttatacgaatgaaattcacgcattactgggtgagaatggagcgggtaaatcaactttaatgaaagtcttatcaggattgcatatgccttcctccggttcaattatcattaaagataaagaatatgatcatttagatcacaaaatcgcaacagaacttggaattgggattatttatcaagaattaagtttaattgatgaattaagcgtacttgaaaatctttatatcggtcgtttaccaacaaaaaaattttggggtattcccattgttgattggtcaaaaatgcgttctcaagcgtctattattttattaagactaggaattaaagttgacttagatgagaaagtaggaaatttatctatttcttacaagcaaatgattgaaattgctaaagttcttatttcagatgtaaaaatcatcattatggatgaacctacctcatcattgactaactcagaaattgattacttatttttcattatgaatcaattacgtaatgatggaaaagcgattatctacatttctcataaaatgaatgaaattcgccaaatttgtgaccgttatacgattcttaaggacggaagtagtatggcttccggtatgataaaagaaatcagtaatcaagagattatccgcttgatggtaggacgtgatatagaatctcggtttatcagcagacaacatactgtgagtaatgaggttatttttgaagttaaaaatcttacaggtagaaaagttaaacaagtcaataatgtttcattttccttaaaaaaaggggagattttaggctttgccgggttagttggtgcaggtcgtacagagttgatgaactgtatctttggcattgataaacgcatttctggggaaatttatttaaacggtaaaaagattacaccgtcatcaccattagaagcagtgaaaaaaggtatggcgtatatcacagaaagcaggcgtgagaatggctttttttccaatttttctatcaagcaaaatattgctgtttcaaaaagtttaaaagatggtggttataaaggtgcggtgggaattttttctccttcaaaggaagccaaacttgcacaacagcaacaagatcttttatccataaaatgtgcgtccattgagcaaaatattacggagctgtcaggtggtaaccaacaaaaagttattatcggaaaatggattgtttgtgatcctgaagtattaatttttgatgaaccgaccagaggtattgatataggggcaaaaacagaaatttataaaattatgcgtcaattagcagaacagggaaaagctattttgatggtctcttccgaacttcccgaaattatgtctgtatgtgatcgcattgtggtattccgagaaggagctatttcctctattttagagaatactaaagcgttaacagaagaaactattatgcgttgggctttaccagagacaaaagaggtaaattaatgatgaatacaggtaaatttaatttttcgcaattttgggataaatacggcacattctttattcttgctgttattgtccttatctttggatctatatccagccaatattttttgaaagccagtaatattcagcaaatttttgttcaaagctcggtaacagtcctaattggaatgggggaatttttcgctatattgatagctggtattgatttgtctgttggtgctattttagctctttcggggatggtgacagcacagttaatgattataggggtagatcctcttgttgcctctattattggtggcattctagtgggaggtggacttggtgctattaatggtgcgttagtcaattacacaggcttacatccttttattattacattaggcacaaatgccatttttagaggtattacactcgttatttcagatgcaaattcgatttacggcttttcttttgagtttgttgatttttttgctcaggatattttcttcattcctgtaccagttatattcgttgtggttattgctattctactttggttcgttacaactaaaacacgattaggtcgtaatatctatgcgttaggtggaaataaagaatcagcatattattccggaattgatgtcaagtttcacactatggcggtctttattatttcaggtatctgtgccggtcttgccggtgttgtttctacggctcgattaggtgcagcagagccgttggcgggggttggttttgaaacttatgcgatagcaagtgcgattatcggcggaaccagttttttcggaggaaaaggacgtatttttgctgtcgttattggtggcttaattatcggtacgatcaataacggactaaatattttacaagttcaaacttactatcaacttgtggttatgggtggtttaatcatcatcgctgtcgcattggatagattaattagtcgttaattttttgaggtaacatcatgaaagtttttatttcaccatcactcatgtgcatggatcttactaaattcaaagaacagattgagtttttggatcacaaagtagcttattttcatattgatattatggacggtcattatgtacctaacttaactctttcaccattttttgttagtcaagttaaaaaactcgctacgaaaccattggattgccatcttatggtaactaacccagaaaattatattgatgatttggctaaagcgggttgcgacatgatcactttgcatgtagaaaccatttcaggacaagcatttagacttattgaaaagatccggcatttagaaatgaaagtcggcatcatttttaatcctgaaacgccaattgaaaaagcaaaatattatttacctaaagccgataaagttacgatattgacggtcgatcctggatttgcaggtcaatcatttattcctgaaatgttagaaaaagtggcggaacttaaattattccgagaaactcataaattaaattatgaaattgaaatcgatggctcctgcaacccgaagacttatgaaatgcttattaaggcaggtgcggatgtgcttatagtaggaagttcaggtcttttcaataattcagataatattgttgaggcttgggatatgcttgaaaaagagatagaaagaatattaagtaaaggaatgttgtaatgaagaaagtatttgttggtattgatatgggggcaacacacattcgcatttgtgtgatggatgagcatcatcaaattctttctactgataaaaggaaaacattagaagtactcaaaaatcaaccgctctatggactaacaacattttgtaaagaatttacaactgactttactattcaacgaattgttataggacttcctgcagcagtttcattggatagaaaagaaattctttctgtacctaacttatctctttctaaacaagaactagacggacttgttccaatgttagagcaatattttcattgtgacgtacaattggaaagagatgttaatttacaattgatctacgatgttaatgattatcaacggaataataagttagtgataggtgtttatctaggcactgggatgggtttttcaatatggaaccaaggaaagctatttattggcgggcatggtgtagcgggtgaacttggacatattccttacggtgatgaacatcttcaatgcgggtgtggcaatatgggatgtttggaaactaactgttcagggactgcactaagaaaatggtatgataaacaacaagcaaattatccattagagcaactttttgatagagcaattcaagagaaattcattcaaaattatcttatcaaagtcgctaaagcaattagtactgcggttaatttatttgatcctcatactttgattttgggcggtggcgtaattgacatgcaaaaattcccatttgaacaactaaaaatattgatcagaaaacacctgagaaaaccattaccttacaatgaattagaaatattaaaagctaaaccttcctctattaatggggcaataggcggagctatttacgctataaataaggagaaatgatgaaaacaatcgctattggttcggatcatattggtttggctctcaaaacctttttaattgaaaaattagaaaaacagggtcataacttactagacttaggtgctgtttcacaagaacgtacagattaccctatttacgctgaaaaagttgcttatgctgttaagcagaatgtagctgatgttggaattttaatctgtggaacaggagttggcatttctattgcagcaaataaaatctcaggcattcgatgtgcattatgttcagatgaacttaccgcactaatgtgtcgtgaacataacaactgcaatatcattgcatttggtgccaatattatatcttcagaaaaagcgatatccttagcaacactttggctgaatacgccctatgacggaggacgacatcaaaaacgccttgacatgatggaaatgcttgaaaaaacaggaagttattgtggattggttactgaaagataaaatctataaaataatataaatatttaagaatatttaaattatgctataaccacacctatgaataaacttttctctatcggacaagccagtaaattgctaagcgtaactattcagacattgcaaaactgaggtaggaaagactgttacaacctgatgagctgaccaaaggttggtatcgcagatataaactggaaatgcttaaagcaattaatcacaatatcgtgcttaatcgagatgatttaaaaaccatttcttatgcaagagtaagtagccacgctcagaaagaagattttgttcttataggtttgttttccttgtgaataatctaaccaaatattactcggatttaatttctttttgaaagcaaaaattttattacagcagatacatctaaaacgttttttggtgaggcaatctgttattagaaaggatttaaaatgttgggggtatttgtgttggaatccccgccctttaggacggggaggtgttgagttttagttatagaataaagtggcttaaatcttcgttctctacgacatcacctaatgctccggtaacgtaatcgccgtcaattatgacgttttgaccgttcatttcactggcattaaaagagatcttatccattaagcgttccataacggtatgtaaacggcgagctccgatgttctctgttttttcattgactctaaaggctgcttcagcgatttttttcaccgcactttcagtaaattcaatatcaaccccttcggttgccatcagtgcttgatattgttcggttagggacgcattaggttcagttaaaattcgttcaaaatccttggcagttaatgcggaaagttcgacacgaataggtaaacgcccttgtaattcgggaattaaatctgacgggcgagcgacttggaatgcccctgatgcaataaataaaatgtgatcggtttttaccataccgtgtttggtattgactgttgaaccttccactaatggcaatagatctcgttgtacgccttcacgagatacatcagcaccgctgtattcgccttttttgcagattttgtcaatttcgtcaataaagacaattccattttgttcaacggcatcaatggctttttgttttaattcttcaggattaattagttttgccgcctcgtcatcaattaatgcttttaacgcatctttgattttcattttgcgttttttagtttgaccggaagataaattctggaacattgattgcaattgattggtcatttcttccataccgggaggtgccataatttcaacgccgatatttggtgcggcaatgtcaatttcaatttcacgatcgtccaattgcccctcacgtaatttcttgcgaaaaatttggcgtgtgttagtattggtatctcgttcttcaatttgtccccattgatctttcgctgggggtaatagggtatctaaaactcgctcttccgccatttcttcagcacgaaaacgatttttttcaatttctgtttggcgtacaagtttcatggcactatctgttaagtcacggataattgaatcaacttctttacccacatagcctacttccgtaaattttgttgcttcaactttgataaatggtgcattagctaatttagccagacggcgggcgatttctgttttacctacgccggtaggtcctatcattaaaatattttttggggtgacttcatggcgtaagggttcttgtaattgcattctacgccagcgatttcttaaggcaatagcaaccgctcttttggcatcagcttgtccaatgatatgttgatctaattcagaaacaatttcacgaggggtcatttcagacataatatattccttgacaattattcggataattcttcgatagtgtgggttaaattggtgaatacacaaatatcaccggcaatttttaatgatttttctacaatttcacgtgcggataaatccgtattttcgactaatgctcgtgctgcagataatgcataatttccgccagatccgatcgctaaaatttgatcttcttccggttgtaccacatcgccattaccggtaataattaacgattctgttttatcagcaacaataagcattgcttctaaacggcgtaatgctctgtctgtacgccattctttagccaattccaccgcactttttaacaaatgtccttggtgcatttccaatttacgctcaaaaagttcaaataacgtgaaggcatctgctgtaccaccggcaaatcctgttagaaccttaccgttgtatagacggcggactttacgtgcattgcctttcattactgtattgccgagtgatacttgtccatcaccgccaaccacgacttgccctttacggcgaacgctgacaattgtagtcatttttgattccttaactttcttttcttttatctgtcgctatatgaggattaactgtgacctttcaaggatatatacaaaataaaattttgatttttgtagagggatagaatttaacattcttatttgaagcactaaaggagcgattgcattgaaattgattggacaatcgccgagattatattaacaatctgtcggatcaagtcgctaaatacagaaaatctctttataatgaccgcacttttaccgcaagtgcggtttctttttactatttttaaaggaagataaaatgacggtattgaaaaatgatcgttacttgaaagcgttactacgtgaacctgtggatatgacgcccgtttggatgatgcgtcaagccggacgttatttaccggaatataaagcaactcgtgcaaaagcaggggattttatgtccctttgccgtaatgccgatttagcttgtgaagtgactttgcaacctttacgtcgctatgatctggatgctgctattttattttcggatattctgactatccctgatgctatggggctgggattgagttttggtgtgggcgaaggtcctaaatttgcacgaccaattgataacaaaagtgcggtacaaaatcttccgattcccgaccctgaacaagagttacagtatgtgatgaatgcggtacgtactattcgccgtgagttaaaaggtgaagttcctcttatcggtttttccggaagtccttggactttagcaacctacatggttgaaggcggaagcagtaaagcctttactaaaatcaaaaaaatgatgtattccgagccaaaaatattgcatctgttattggataagttagcagacgccgtgatactttatcttaatgcacaaattaacgctggtgtgcaggcggtgatggttttcgatacgtggggcggtgtattgggacatcgtgaatatttggatttctcattgcaatatatgcacaaaattgttgatggcttaattcgtgaaaatgacggatataaagtgccagttactttgtttacgaaaggtggtggtttgtggttagaggcaatggcaagtacggggtgtgatgcactaggtttagattggacggtaaatttagcagaggcaaaagcacgagttgggcataaagttgcgttacaaggaaatatggatccttccgtattatatgcttcgcctgcacgaattgagcaggaagtacaacaaattcttgccgattttggacaaggtagcggacatgtgtttaacttaggacatggtattcatcaagatgttccggaaattagtccgaaggtttttgtggatgctgttcatcaatattcaatattctatcatcaataaaagtgcggtgaaaataatgcgaaatcctattcataaacgcttagaaaaatttgaaagttggaaaaatatcacatttatgctgtgtttatgtgaacgtatgtaccccaatttttatttattttgtcaaatgacagagcaaatggataaagccaaaatatatcaaaatattttgaatttagtttgggaatatttaaccgttaaaaatgccaaaattaattttgaaaatcagttggaaaaattagaaaatattattcctgatgtgaataattatgaattttttggtgttgtaccggcattagatgcctgtgaaggcttatcggaattattacatgcaattattgctggagaaacactggagaaagcaataaaaataagtcagttgtcgttgcaaactgtgataactttgctggaaactcagcaagacaaagcgttttctgaagccgagttgaagcaaagtgaagaaattgaattggaattggatgtacagtggcaaatttatcgtacgctgaatgagcctgaagaaagagatattagactgattttagatttaaaaaatgagttaagagagagcagggtgtctaatatcggtatagaaattgctcaataatgtgatttagttatcaatttttacagatattacttttttttctataaaacttagattatgcttgacaccactgtagttgcagtaattgttgccgctggaagatgagctatctttttcggcacttttaaaaaaatttaatatgaagaaggtactaatttatgaataagacagacttaattgatgcgatcgcaggcgcagcagaattaaataaaaaacaagcaaaagcggcgttagaagcaaccttaggtgcaattgccggcagtttaaaagcaggtgaagctgtgcagttaatcggttttggtacatttaaagttaacgagcgtaaggctcgtaccggtcgtaacccacaaaccggtgcagaaatccaaattgcagcatcaaaagtaccagcatttgtagcaggtaaagcgttaaaagactcggtaaatagctaagttatttttctctatctactttaaacctcgcatttgcgaggttttttgttatcttattttttctctacctctacctctacctttctttctaaatcaaaacgtatttacaattctttttttttatgtaaaattcgaaacgaaatttaaattatggtttttttatgaaacgaaacttttatcctaggaataccgaacagcgtcgtcaagtgataatgcagttactgcaagacaagggagagattagtgttgagcagttagtgcagtattttaatacatctgaagtgactattcgcaaggatcttagtgcattagaaagtagtggttttttattacgtaagtacggaggagcagttttaataccgcaagagccattggaagcaaatcacgaagaattactttctaatcgaaagttagctattgcaaaagcagctgcggaacgtattgctgataacaacagaattattatagatagcggtagtacaacagccgcacttattaagcaattaaataataaacaaggcttagttgttatgactaattctttgtctgttgcgaatcaattacgatctttggagcatgcacctacattattaatgaccggtggtacatgggataccggatctgaatcatttcaaggcaaagtagctgaacaagtattgtattcttataactttgatcaattatttattggtgcagatggtattgatttagctagaggaacgacaacgtttaatgaacttgttgggttaagtcaggtcatggcagaggttgctcaagaagttattgtcatggtggagtcacaaaaaattggtagaaaaatgcctaatttagaattaacttggcagcaaattgatgtattgattaccgatgagctattgagtgataaagttaaaaagcaaattgaattacttggcgtagaagtagtctgcgtaagtgcggtataaatttttttattttaaggaagtaattatgtgtggaattgtcggtgcagtggcacaacgtgatgtggcaaaaattttaattgatggattatatcgtttggaatatcgagggtatgattctgctggtgttgcaatattaaatgagcaacgtcatgtacaaattgtacgcagagtcggtaaggttcaggcattagatgacgcaattgaaaagcaacagttatctggaggaacgggaattgcacatacacgttgggcaacacatggggagccttcagaaattaatgctcacccacattgttcgggaaaaattattgttgtacataatgggattatcgaaaattaccaagaattacaagaagttttacaacaacgaggatacatttttcaatctcagacagatacggaagtgattgctcatttagttgaatgggaattgcgtagtgcaaacactttactggaggcggtacaaaaagcgattgctcaattgcgaggcgcttatggaaccgttgtgatgaaccaagatgagccggagcatttgattgtggcccgttccggcagtccgttagtcattgggttaggtataggagaaaattttttagcttcggatccccttgcattattaaatgtaacacaccgttttatctatctcgaggagggtgatgttgcagaaattacatgccacagcgtagatatttttgattttaatggtaaacaagtagagcgagcagttcataagaataattttgagacagatgtaatagataagggaccttatcgccactatatgcaaaaagaaatttttgagcaaccgcaggcaatcatgaatactttagatgggcgtattttaaatggacaggttaatattgaagctattgcaccgaatgcagaggaaattttacggcaagtagaacatattcaaattgttgcttgtgggacttcttataatgcgggtatggttgcacgttattggtttgaatctattgcgagagtgagttgtgatgtggaaattgcatctgagtttcgctatcgcaagtctgtaactagaccaaatagtttatttattaccctttctcaatcgggcgaaacggctgatacattagccgcattgcgtttagcaaaacaatccggatatatgtcagtcatgactatttgcaatatagccagttcatcacttgttagagagtctgattttgcctttatgacacgtgcaggggttgaaattggagttgcttcgacaaaagcgtttacaacacaattaacctgtttactcttattaaatgtagcacttggtcgtattaaaggatctattaatgtagaacaggaacgtaatatcattcgatccttacaacgtttaccggctcaggttgagagtgctttggtttttgataagcaaattcaaaaattatcagaagattttgcagaaaaacatcatactttatttttaggacgtggtgagtattatccgatagcgatggaatctgcattaaaattaaaagaaatttcttatattcatgcagaggcttatgccgcaggtgaattgaaacacggacctttagcattaattgatggtgatatgcctgttattgttgttgcaccggaaaatgatttgctggaaaaggtgaaatctaatattgaagaagtgcgtgctcgtggcgggcgattatatatttttgctgatcatgagttcggttttggtaatagcgatagttttaaaacgttggtattgccaaaagttgatgctatcacagcaccaattttttatacggtacctttgcagttattgtcttactacattgctttaattaaaggcactgatgtggatcaaccccgtaatttggcaaaagcagttacagttgaataaaaaatagtaaaagtgcggtaaaatttaccgcactttggttatttgattcaagttgctaccgtaaacagctattaccagccttttgcgacaccgtctttaaagtgtttgtaagcttcttgataaacttcctctgtttgataggcttttacaaagttttgtacttctacgctgtctttattatctttacgagcaacaataatattgacgtatggagaatctttatcttcagtaaagataccatgttctgcactgtttaaaccgacttgacctgcgtaagtattattgacaacagctaaagctacatcatctaacgcacgagcggcaacagaagtatctacttctttaatctctaaatttttcggattttcgataatatccaatgcagtagagaataaatttgtattatcttttaatttaattaatccttgtttttctaataaaatcaacgcacgagccaaattgcttggatcgttaggtacggcaactgtatcaccgtctttcaattcactgatattcttaatttttttagaatagccggcaagcggataaacaaaggtgttacctacaatttccaagttggtgatatttttagattgtgtatctttatctaaataaggcttatgttgcattgcgttaatatctaaatcaccttttgatacagcagtgttaggtaatgcgtaatcattaaatatgacaaattccactgctaagttatatttttctttagcaatctgagctgctttttctgccacttgatgttcaggacctgccattacgccgactttaatttttgccggtttgttttgatttgctactgtttctgtttttttatcatcgttacaagctgtcaaggcaacagttgaagcaatggcaatagttgcgaaaagtttgtttaatttcataagatttcctcttaaatagttgtgtttaaaataaattagcgatgatcaacttttttagctaaatcatcccctagtttttggctaataataacaaataacacgatgataatggttgaaatccaagtgatgaatcccataccacgatgtactccgtagttaatagctaaacttcctaaaccacctcctccttgggttccagccattgcagtatagccaattagcgttacaaaagttaatgtaattccattgataagagagggtagagcctcaggtaaatagaattttgtaataatttgccaattggtagcacccaatgcttttgctgtttctgtcagtccggttggaatttcaaataaggcattgctggttaagcgagcaaaaaatggaattgcagcgacacttaaagaaacaatagcggcattagttcctaatgaggagccaacgatatagcttgttacaggaattaagatcaataacaaaataatataggggatagatcgacctatattaataatgacattgaaaattttattagcattgctattttctagaatttgttttttgcccgttaaaaaggttatgcaaccaataggtaaaccgatgaggactgcgataaacgttgacacaatcgtcatataaacggtttcccaagtagaaatagcaattttgctccacatttccggcgttaattgttgattgaacgtaattagcagattatccaacatagcctaatacctccacacggacgttattttccattaaataaattttagtttgcgagatggcttcttcctcaccttcaacttcggcaataacaaagccgaattttacctcaccggcgtaatctatttgtgaacttaaaatactgagatcgacgccaaattgtttagatgcttgagataataacggtgcatcaacggagcgaccggtaaattcaaatttgataattgggtaagattttgcatgttttggcgttgccgataaattttccatatattcttccggtagattaatatggaaagttgaatgaataaactcttgagcaagaagggttttcggattagagaaaatatctccgacagaaccttgttcaattaattgccctttattaattaccgcaacttgatcgcaaatacgtttcaccacatccatttcgtgtgtaatcagtaaaatggtgatacctaaagtgcggttaatttcttttaataattttaaaatagattgtgttgtagccggatctaatgcactggttgcttcatcgcacagcaataccttaggactgtttgcaagtgcacgagcaatagcaacacgctgtttttgtccgccggataaatttgccggatagacatcttttttatcatatagtcctactaaatttaaaagagcgtcaactttttgtttaatttgggttttatccgttttctctagttctagcggcagtgcaacgttatcaaagactgtgcgtgagcttaataaattaaagtgctgaaagatcataccaatatgacgacgagcatgaattaactcgttatctgaaagttgagttaaatctgtattatctacaatgacagagcctgaagttggacgctccaataaattgatgcaacgaataagagtactctttcctgctccggaggcaccaattactccacatatttgtcctcgaggtacttcaagactgacattatcaagtgcggtcagatttttgcctgaaacattgaacactttactgatattttttagcttaatcatataagcccttttctatatagttaaattaaaattagcttgtattttagacgtctagattgctatgtcaatatttattgaatagatttttataaggatttattagttattggcgatataataaagaaactttgtttttcatagaggtattatgtatatgaataaagcgatttttttagatcgagacggcacgttaaatatcgatcacggttatgtgcatgaaattgacaaattccagtttatagcaggaagcatagaagcattgaaacaacttaaatctatgggatttttattggttttagtcacaaatcagtccggcattgcaagggggtatttttctgaggaacaatttttacagctcactgaatggatggattggtctcttgcagacagaggcgttgatttagatggtatttactattgtcctcatcacttagaaggaatcggggagtataaacaagattgtgattgtcgtaagcctaaaaatggcatgctactgcaagcaataaaagaattaaacattgatcctgcaagatcttttatggtgggagataagaaagaagaccttttggcggggaaaagtgcggggataaaaaagaatattttggtcagaagcggtaaagaaatcaccgatgacggattgtctttggctgattatgtgttggatactattgctgatttacccgaattaataaaaaaattaaaattttaaccgcactttttattaaaaaattaggctatgtcttaaaataagattgaatgatgaaattcagttttttgcgttctgtttgcataattgctcattctgtacatacaaaaagagataacatttctgctatctctaatgcctacaatcatattttttagtttctacctacaagctgttttgttgcttcaattttcttatctttccacataacaacatcttttataacaagtttttggacagcagaaataagaagttccatataggaaaagtctatttcgttattttttgttggcagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaacgcttctttttcctcactagacaattcataattgtctagtccgcttaccgttaggtaagcggagagttcacttatacgctcctcttcgagttcacttataaagctctccataaattcaaaatctatttttccattttttattggtagttggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaacaaatccctaattctatactcgccccactgaacattttggagtttttcattcagtggggcatttatttttttaggtctttattctccttatctgtatctttaagaagattagatacttcccaagcaaggtaatcagctacagttttcttgaaatcttcaagagttggtcttgtatctatcggtgctgattgattccagtctgaaccatttaaagggtcaatatgaccttcgtaatattctttttctgtaaagatgtttaatttttgttttccaaaacgcacaaggtctactacttcttgatatctttcttttgctctgtcggtatctctaagatttacacttgctttttttctgttcgttcttgtgtatccatcgtttgaaaagtcgataaacttcacaacttcatctctttgatgagattcgcctactctaaatacataaatatttgtttgaacacttgattttccaacaaataaatcgatgggcattttaatacttgcaagtagtgtattttttgctagtatcttcttgttaagttcttttgcttttccacttcctgcagagttttgaatgatgattgctgcatagcccttgttcatcatagatagggctttttctacgaaaatcattccattgccctctgctgaataaggcggatttaacacaaaagcagtagctggaaatttctcatctgttttaccaaatccatatttaccgtcaaaatcatgtagcgagtctttatttaagatgtttgagctaccatctcccataagtatcatatttaaaatggcaagcatatagatgttggatagaacttctaagcctaaaagctgttctgcttttatctttagttgtttttgctctagctcaagtggtgatgtgatttttgcttttgcatctataatcatctcgttcattgcagcaacaagtagccccgcacttcccgttgcaaaatcccacacatagctgtctttatcaactcttgcaagttttactaaaaaagttgctacataagatggggttaaaaccacatcgtttaatttgtcttgcgtaaagccgagccaagagtacatttcattaaagagcttacctgtaaagtctgtagttaagcctattttgtagtaaatacctaaatcgtctacgatttttgaaaatattctttttaattggctttctccgtttattggcttattaatattttctgataataatgtattttttagtgttcttacgataaggtcttgttttgtttttggtaggtttttcttttgtaaaaacgcttttatttttctaacgatcttttcgccgtctgtgtttccctcttctattgatgattttaggtcagacttttctagtggacttacccccccccggtattcctagtgttgccataatagaagctgacacaagatagactctgtcgttttcactaagccctttttcatttgcgtaaatatcattgtttagctttactaaacttgcatttatttctttttcacgtttttctttaagtgcttcaagctcttcagcagataaagaaagttcgtttacttttttaataaaatctgtaaagttttcttttcttaaaaatgaaaggtctgtgtattttcctacttcttgccctatcccaaaattatcttttgatacatagtaaacgccaatagagtgttctatttccccgttttcttttttatatcccgtaacaccgattgctattacatctgtgtagcttgtgtagtgaagtatggcattggcataatgaaccgctccatttacagcatagctattaatatttttgtaattaggctcgtttttacttgttctattgtcaactctaccgtcaatgtctaactttactaatttatctttatatcctttatattctatcagtattggataatagttaagtgcctcatcttgcaataaaagttttgcatccggtctatttccacccgttccgccactttttgatttatattcatcaagtgccttatctatttgtgcatttagactttcttgttctaatttataatccagcccataacttttaagccacccatttacaaggtcaactatgtttggttctatagattgcattttaaccattgtctattctcccttttcaacatattcatcatcaaaagaaaatccatcgttcggcgtgcagtcaaatgccttgaatattctctctaaatttttaagtgttatcggtttatttttcccatttttgccataatattggttgttaaatctgacattgttataacatcaattttccttaagcctgtcaatcgtattttagaatgcaaccaaaaattatcttaaaaacccttaataataagggctttgggtgagagagtttttaatgagaacgttgtactagcaagtgcattctggcgatattttgagcggtagattctagattttgtctgccttgagccaaaatttcaggcaaactgtctaattgacgaataatggggaatactgcatcaatgccatgctcatagactacttcataatcttcccgtaagcagcctgtaatggctataacaggtttatttgccagtttggcagtttttgctactccaataggcgttttgccgtgaatagtttgtgaatccattctaccttctccggtaatgaccaaatcggcatccttgataatttctgctaaatttactgtatcaatgacaatctgcacaccggatttgagttgtacttgaggcaataatagcaatccaccacccataccgcctgcagcacccgatccgggacgctcagcaatccgttttccgcaatctcgttctacaatacggctaaaatgcagtagagcttggtccaattgttgcaccatttccggtgttgctcctttttgtggaccgaaagtagcagaagcacctttttcaccatataaaggattatttacgtcgcaagctacattaaattgaacttgtgtcaaacgttgatctaaatgtgcagagtcgatatgagcgatttgttgcagagctagaccgcccaagccgatttcttttccttgagcgtctttgaatttgatacctaaggcttgtagcataccgacaccaccgtcattggttgcactgccaccgatacccaaaataatttggctcacccctagctccaaggcggcgttaattagttctcctgtaccatagcttgtggtgtagtaaggattgcgtttttctatcggcaccaaatgtaaaccggaagccgccgccatttcaataattgcgatttttccatcacccgatatggcaaattcagcttgcgttttattacctagaggtgcggtaacctctacagaaatcagtttgccttgtagtgcatcggcaagagattggactgtgccttctcctccatctgccatgggaacttttacataatctgcattggggtagatttttttgaaaccattttcaatagcttgagccacttcaagtgcggttaaactttctttaaaagaatccggtgcaatgacaattttcattttagttctccttgatagtgattgattaaaataattgccatacaccaaaaatcagagtagagataattgtcatgatcaaacctactgcagtttcgtatgggattagttttaaccgctctttaatatccatattaacactaccgccggttgcatgaaagaaagaaccatgaggcatatgatcgaagacggttgcaccggcatgaatcattgcagccgctgcgataccgctgacgctcagttccattaaagttgctccgaacacttgagacgctacagcggttcctgctgtagtggaagctgtggctaatgacattaatcccccggaaatcggtgctaatagataagaaggtagtccggacgcagttaacccttcaattaagagttcttttaattcggaattagcgattacaccggctaatgttccggtacctaacaacatcacagcaacaggtgccattttacctaatcctatcactgcatattgatttaagtaacgtgttttattcatgcaaattgtgcctacaataccgccaagaggcagtgcgattaaaggatcaatttttatgccgaataatgggcgaagggcaagtaaaataatagtaaagagcggtgcaataatcgctggcaagaattttggtaattcgccagtgatcccaacgatttctttttcacttacttttgagcctttattcattaggcttttggctagaaaataggtgatgattagaccaaaaacagcaggaatgatgcccgctgtcatcactgaagttagagggatgttgaaggcatctgatgcagcgatagcatttgggttaggagacataatattacccgctttaccacccccaatcatggctaacaaaatagccattttggataaattgctacgttttgccaatgccagtgcaattggggcaactgtgatgactgcaacgtcaataaatacacctacagccgttaataacattgcggcaagaatgagtgccaacaatgatctggattcacccagtttttttacgatagtatcggcaatagtacttgccgcaccggattcaattaatacacctgccagcacaccagcggctaaaatcctcataacagcggtagtgataccttgtgctccgcctatcatcagcgtaactgtttggcttagatccgcacctccgattaaacctcccacaagtgcaccaataatcatgccataagcaggtgggacttttttcaaaatgagcacaattgcagtaaaaagggcaacaattgccccgagagcagttacagttatcatgatcgtttcctcatatattaataaaaaatcatgttgtgtattattgaatgtatgaggttaaaaaatcttcatatataaatacaaaaatacctgataaataggattattttttgtatatttatacaatttattggtttagcaatgtgcttaggtagagtgtaaatttttcatctatcttattgaaagacaagccggttattttctcaatcttgcttagacgataccttaatgtattgatatgaataaataattgttgtgaagtgagagcaagatcacaatttgaaaaaaaatactgttgcaatgttttttgtaacagatggttttcgtcttgttgatataaggtatcaataggttttaataactccttactttgccaagtactacgtaagttatctaataacgcaggcaatttatattgattaaagaaatagatggatttcttaggaaaataagtttccccataacgaagggtactaagtgcggtctgaaatgaaagtgaaatgttgcgattattttcaacttcggaaccgatagccactttcagcccttttaatcccgaaggtaatagataaggaggaaataatttctgtagtccttttgtaccaagtaaggcttgaagttcttcagcaggttgtataagtgcgattttatcatgcgataaggttgcgaagtggttaatcgattgttctaaatatccagcaagcttttgaagtttctctgctgtggggtgcaaaatttggataataatgaccgcacttttagtgtgtagcgttagtccgaaaaaagcactttgtttctcaatttctgcctcgttgagtttaccttttaataaacctagaataaactcttctttataacgtttatcccaacgttctttttctaacaaaaagtgttgttcaatcatcaattcagcagtcattttaaccatttcaccataggatcgaacagtgtcgggatctccggaaatacctacaacacctaaaatttctcccaaataactaatgggaagattaatgcccggttgcacttcaaataaccatttttcagctaactcctgatttatttctatagtttggttgtgacgaatagagtatatggcaccaatatgtctttgttgcaaacggtgaggattacttgaggcaataataatgccggtttcattcattacattgataggcttatgtagaacacggtttgttcgttgcacaatattttgagctaaagaaacgcttaatttcatgttcatagcaggacatttactgtaattatcaatagagtgactctcattttatgagaattttagacaaggtaaaagtataaaatttcagcaagtaaaaaatttttttaaaaaattacttgcattgaaatataaaatgcctataatgcacggcacacaacgacacgctgttgtgagaggttaagcagtgtgtcgttattttttgttctttaacaaactatcagacaaactgtgtgggcacttgtgagactgtattaataagagattaaaagagtaagataagtgcttaaactagagaaattcatagagaaaagatggatgaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggactaaaggggtgggactgtgaggccacctgccatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaagaagcgggacaggatagagagaggaagacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgatatgaccctgggtggagacactcagggttttttgttatttgggataaggcggggaagagagaagagrgaagaggaaactgggagaaaaaaagtaataaggtgataacaaggtagtcataaaaagtagggtaatgaagcagagtgaagaggtgcggtaggaaaattgtttttttttctaccgctctttttgtaggtgatttatttatcgtttgccttattcatacgtccggcaaacaatatctttttcttcacaaaacatctcactatgctgtgcttgacactgtctttgtacattaagtttagctcggcctctgttgctatgctcactgcgatattcttgagtaaatggttttaatgtacaaacatgaatagcatcaaaatcagtttgttccgaaacaccgatgaaaattggaactggaatggctgtttgatcttttgttgatgtcggtacaacgcaacttgttaataatatacacaaaccgattaaacaaaaacgcatatttttctcctaaaaataaccttaatttcaaattttaagacgattttattatactcaatttttacaagaatgttcagagaaatgacaaaacatatagttttactttttctccataaaaatgtaggcatgatgtaattgaaactaagttgtatctcgtgtttaattaacattcatgccgatatcgaaaacatataagcaatatttgcttcgtttgttacaaattatttttcaattcgtaatccataagatttaaatttctctaatacaatctccatttcttttggagttaacaatgggatttctaaacctgtcgctaaaagtttcatgtaccattgtgccaagacttcaacttcatgagcaagccatagtgctttatcaagatttttctctgcagcaattaaaccgtgatgtgctaataaaattgctttatattttttaataccttgttttacatgctcagctaattcatgtgtaccaaaagttgcataaggaacacaaggaatatgatcagcaccgcctacggcaatcatgtaatgaaaaggaggaatgggtttttctaaaatagagacagctgcacaattgattgaatgattatgtacaactgcatcaacatcaggacgtgcttcatacacagctagatggaaatgccattcactggaggggaatttgccttcttcatgtttgccatgtttatctacataaacaatgttgttttcagtcagcaattcatatggcatgcctgtaggagtaattaacataccgtctttatatctgacactgacgttacccgcagttccttggtttaaaccaagtcttgtcatttctaaacaggtgaagataattttttttgaaagtagtgatctatccatttttattgtccttctatttcacaggtgtaacaccttttttaataataatattgccgtattttgcagtttcaccggtaataactactacataagcctgttttgctcgctcataaaaagcaaaacgatccattcttgctaatttaggcacattacctaccgcacttttaattgtttgaagatagctttgctccacagcgggatccaaactatccccttccactgcttgcatcataattaacggtgcctcagtataagtatcaaactcaaataaaggggcaatacctgtcagtaaagaattgatactaataccgtcagcacgaacaactttatgatgcaattgatgagctggaaaatgagcatcagataaaactaactcatctccatgtcccatttctgctaaaattttcaacaaatccggtgaaattgccggatgaatcccttttaacatatatcctcctgaagttttttataaaattccatatctgttgaaggctcaattcgtcggaatgtcggcttcattttttgctgtgcctcttcgacgtttgcaaaaacgcccgcaccggttaaagtaaacatagcggcacccaatactgtactctctgctatatcaataacatcaatagggcaacctaagacatcagcacgaatttggttccaaagtttatttttagatccaccgccaaccacaatcaaacgatccgcactaaaatttcccactttttgtaatacattcaagcctgcttttaaacggtaagccatgtattccaaacctgcacgataaatttcgccacgtttcgtatgcattgataaacctttgatttcacctgtttgttccattttgccgtcaaaatttcctacgagcttcacgccattggaaccggcaggtactgtttcgccctctgcgatcatagtttggtaatattgctctttggttacatcggaaaagaattgtttgcccaaccattcaatcacacccgaactaacccattgcactcccggattaaaagcatcaggcagactatcaaattctatggttaaaccatctctgacatattgccattgtgcttgagcttgctgtgttcttaccattaaaatttcccaagtacctgaacttaaaacaggttggttatatttggcaccggaaccgaaaatagcaaattgagtgtcatgtccacaggaaagtactgggatatgtgttgataaacctaaatattttgccaactcaggtaataaattacctattttttcacccgctcttttcatcggtgggaaatgttgttcgttcaaacctagaaaatctaaaacttctttatcccaagagtcattttctatatttgtcatcattgatgtacctgccatagtacgatctgtactaaattgacctgtcaaacgttgagttaatatagatgaaatgaatacccacttatccatctcggcaaaaatatccggtttattttctttcaaccacaataatttgaacaatgtattgaaactatattgtccaataccattacgctgatagagcttttttacatcaaggtattgatgaagtttctccatgacaggcaaagtgcggggacatttccaagaaattattggaaaaatttgcttcctatttttcgaaaaaggagcaccatctacaccaaaggtagtaataccaatccctttaatttcagctaaatcaatttgtttttggcgtagattcacaattgttttttctgcacaaaaaataagtttttggtagatttcttcgatgtcccaaatatgataaagagagttttcaggatcaggttgagtgtgattaggtgtatgatgtgatgcaacgattttacctgcttcatttattgcaatggtacgtaaatttgttgcaccacaatcaaaaatcaatgcaattgccataataactccataaaatcatgagcttattgcttaattaagaggggaaatttagtccttccccctccccttggatttcataaattaacgatataaaggaccaaagtttgcacaagcacggtaatcttgaccttctttatcttgaccaaatgcactccaagcacttggacggaaaatgtctttttcttcgacattgtgcatacagactggaatacgtagcatggaagcaagagtgatcaaatcagcaccaacatgtccataagttgcaacgcaatggtttgccccccaatttgccatgacagaataaacgtcagtaaatactcctgtacccgttaaacgtggaacaaaccaagtagttggccatgtttgatcagtacgtttatttaaaatatcatgcacgttttctggtaaagcaatagaccatccttcggcgatttgtaaaacaggcccaatacctttgactaagttaattctatgtatggtaaatggcatcccgcctttagttaaaaattgtgacgataaaccgcctcctctgaaatattcgtgtaccgccggacaccaacgagtattttctaagcaacgctttccatcttcttttgttacttcccataccggtttaatgactgatgttccgtttggatctgtatgttgtcccgtgccatccaaagcggcagagccggaatttagtaaatgaataaatccactttcaggacgccaacctgttacacgctcaacagaatcttcactccaataggtacgtacatcagcaaaaatttgagcctgaccggttagcaaattgccgaataacatgttaacgccatttaatgaatcattttctgtggctaaaatataaggaggacgtacaccgttccagtcataagttgaattcaatattgcttccataaagtcgccgttcggtagatgatctgtccaatggcgttgaccttggaaaccagcactaatcgcattatgtcccattgattcttctacataaccaagttcagctaaacgaggattaccaaccattagatctcgacaaataatcgtcattttgacaacattttcccaaagttttgcacgttcttccgaactacgctgattttcttcagcatttacatcaataccttctttacagtattgagttacccattccattgctaatttaacttctttttcatcatagattttgcgatctaaacggcgtttaatttcggtcatatctacatattcattacgcatatccaaatattcttgaaagaatgcttgattaacgatagaaccggcaatacccatagaaactgaacctatagataagtaagatttaccacgtaaagtcgcaactgcgagaccggcacgagcaaaacgtagtaatttctctttaacatctgttggaattgttgtatcagatgcttcttgaacttcagtaccgtaaatagagaatgcaggtagccccatttggttatgtccggcaagagccgctgccaaatacaccgcaccgggacgttctgtaccgttaaagccccaaattgcttttggcatatgaggatccatatcaattgtttcagaaccatagcaccagcaaggggttacagtgatgactgcaccgacattttcccgtttgaatttttcagcacatgcagcagcttcagcgacaccaccaatcgtggtgtccgcaattacacatttcacaaattgcccatttgtgtgccgcacttccgtttcaattaattgagccaccgcttttgccatattcatggtttgatcttctaaagattcacgaacgcccatacgacgtccatcaatagttggacggataccgatttttaccggtgttgattttaaatgtgtcattttttattccttcttgatgattaagtttattttttcacaaaaaacaacagaacatagttttttgtgtaatttgtaaaattttcgtgagataaatcacaaaaaaatccttttttgggttaaatttcttgtttttatttgcccgatttttaaatgattcatgatttttcgggcaaaacgatcaaatcaggcttcgaattatttcaataccttccaacttctatagccataaatagtaattggaataaagcagattaatggtagaacaaaagaaatgttcacagcaggcaaattaaaaatttcacctttatcaatgatcatgccttgtaaaggtggcattaatgcaccgcctacgattgccataactagacctgcggcaccaagacttgcctcttcttttaaaccgtataaggcaataccgtagattgttgggaacataagagacataaaacctgaggttaaaattaagcaatataatcctaattctccatcgataaaaattacgcctacaatgcttaagaaaccgccgataccaaataggcataacatcaactcagcttttaagtatttcataatactggtgctgataaagcgactggcaacaaaaattatcattgcaataatattaaaattttgtgcttcagatttagtaaaacctaagcgttcggcatattggataataaaggtccagcacataatttgaacacccacatagaaaacctgagcaattacaccttcacgatactttgcattttggattaggcgagaaaatgcgtctttgaatgcaattcttccccccccccctagctcttccatttttgtagtaggcattttgtataaactaatgactaacatgatgattaaaacaacacctccaacagctaaataaggattacgaataatttctaaatcatgggtgcgtatagtcgctttttctgcggtagataaggtattaaaaattagatttcccattgcatcacgtttttcagattctaggctggttaatactacttgtgatgccacaaacatacctgtaatcgaaccaagtgggttaaaagattgtgttaaatttaaacggcgggttgcggtttgcggatctcccatcgaaagaatatatgggttggctgtagtttctaaaaaagctaacccaaaagtcagaatataaagtgatagtaagaaaaaagtaaattcttcatacaaagctgccggatagaataagaatgcaccaactgcataaagggctaaacctaataagacaccggatttataattaaatcggctgacaaaaagtgcggctggaattgccattgttccatagcccccataaaaggcaaattgaacaagagcagcttctgatgctggaatttccataacagtttggaaaacggctaccattggattcgtaatatcatttgcaaatccccacaaagcaaacaaactggtaattaatataaaaggtgcaataaattgcttttcaagagttttagctgtcatttttctttccttaattatgagagtagtttcaaggattacattctcgtaaaattatgctgcgtgctttgcatcattttttgaaagaatgttaaaactattagaaaggaaaaatagaaagacaataagaaatttatgaaagtagttaaatttctgtgaaattcatcacaaaaaacgctaaaaaaattaaaagataatgcccgaattaaatcaattcttttgtaaatcgggcattattttgtttggataaagaggatttaaacaatagtgattaaaacatcagatttttggcagtatgatgtcaaagttggatttggaacttggtctgtaaataaaatatctatttgtgataaatctgttaaacgaatcaaatttctacgttcaaacttagaactgtctaataagagaaatttctgttcgcaagcatccattaatttacgtttaattgaggcattaagctcatttgattcccaaactccaccgctactatcaatgccggtgcaagagaaaatcccaatatcaatatgtaaacgttgtaataattgttcggataacggtccataaaaagcatcatatttcactgaataaacgccacccgttgcaatggttttaatattaggtttattaacaagtgcggtaatgttatgcatagaattggtcactactgtgcaaggaatatcggggatcatttgtgcaaaatgccagctggttgaactggcatccaaaccaagtacaataccttcaaacatatattcaatggcggaagcggctatggcacgttttttatcgcaattaaagcgttgtcggctttgaaaagaactcccgacatctttcgctttacggctgacagcacctccatgtacacgatgaattaaccctctcttatccagatcggttagatctcttcgaatagtttccacagatacgtcaaattgtttagctaaatcatttacattcacttttccggatgaatttattaattgcaaaatcaatgtttctcttgatgacatttcttttctccaagcagtcaagatggttacgaaagattacacgctaaacggtagtaagatcaactgttgaaaaattaccgcactttgccttaaatttattttactgtcattggtagtgttaatatgttcaagaagaattgcgtcagatcaggaaaagctgacttttcactttaaaatatactcattttttgctataaagtcggcagttttttacttaatacttaggagatattttatggagttagtatttattcgccatggttttagtgagtggaatgccaaaaacttgtttaccggctggcgtgatgtgaatttaacagaacgtggtattgaagaagctaaagcggcaggtaaaaaattacttgaagctggttatgaatttgatattgcatttacctcagttttaactcgggcaattaaaacctgcaatatcgtgttagaagaatctaaccaattatggattcctcaagtgaagcactggcgtttaaatgagcgtcattacggtgctttacaagggttggataaaaaagcaactgctgaacagtatggtgatgaacaagttcacatttggcgtcgttcttatgatgtttctccaccggatttagatccgcaagatccgaattctgcacataacgaccgccgttatgctcttttacctaaagacgttgtgccaaatgctgagaacttaaaaatcactcttgaacgtgttctgccattctgggaagatcaaattgcacccgcacttctttctggtaaacgtgtacttgtcactgcacacggtaactctttacgtgcattagcaaaacacattatcggtatttctgatgaagaaattatggcttttgaaattccaactggtcagccgttagtgttaaaactggatgaacagttaaattttgttgagaaattctatctataatttctttatatacctaatcaatggctgagggcatctcagcctttttgtatcactttttacattgatttgattttatcttgtcgcaattcctctttaatttctgtacaattggcagattttgtgtttattgagatattctatgagttcatccccaaatattggctttatcagccttggttgccccaaaaatttagttgattctgagcgtattttgaccgagttacgttctgatggttataatattatttccagttatgaaggggcggatttagttattgtcaatacctgtggctttattgatagtgcggtgcaggaatcattggaatctatcggagaagctttagagaataacggtaaagtgattgtaactggttgtttaggggcgaaagagaaccaaattcgtgaaattcatccgcaagtgctggagatcacaggtccgcatagctatgaagccgtgatgaaacatgtgcataaatatgtacctaaacctgaatacagtccttatactagtcttgtgccgaaacaagggataaaactgacgccaaaacattatgcttatttaaaaatttcggaaggttgtgatcatcgttgtactttttgtatcatcccttctatgcgaggtgatttagatagccgttccattgtgcatatactcgatgaagccaaacgccttgtagatgctggtgtgaaagagattttggtagtatctcaagatacctctgcttatgccttggataagaagaaagaaaatgccagtaaaacggtattctggaatgggatgccgattaaaaatgatctgattactttatgtgaaaaattaggttcgctcggtgcgtgggtgcggttgcattatgtttatccttatccgcacgtagacaatctcattccattgatggcagaaggtaaaatcttgccttatttggatatccccttacaacatgccagtcctaaaattttaaagatgatgaaacgtccgggttcaattgaacgtactttagagcgtatcaaaaaatggcgtgaaatttgtcctgatttaactttgcgttctacctttattgttggttttccgggagaaacggaggaagatttccagttattattggatttcttgcaagaagcacaacttgatcgtgttggttgttttaaattcagtcctgttgaaggtgcggtcgccaccgatatggaagatcaaataccggaagaaatcaaagaggaacggtttcaccgttttatgcagttgcaacaaaaaatttccgctgaacgtttacggcaaaaaattggtagaacattatctgtcattattgatgagattgacgaagaaggcattattggtcgtacgatggcagatgcaccggaaattgatggcgttgtttacgtagataatttttcaaaagtggaagtaaaactcggacaaattattaatgtaactattaccaacgcagatgaatatgatttatggggagagatttaagtgcagttaagtgcgggttgaattaccggaatatttattctccctcagaagcagtgatatattataaaattcaatttccaggatatgtatcatgttatttttacgacaaaaattcaaaaatagattaaaacttaccgcacttttttatgtagtttatttgctgttttcgtttgttgctcgtgccaatgaacttactcgcctccaagaaaaaattaagttacaagaacaaaaaattgcccaacaaaaaaatgaacaaaatgaattacaaaacgtattaaaaaaccaagaaaataaaattagtcaagcggaagataaattacgtcaaacagaagaaaatttgaaagaaacacaacaacttatcaatacaacagataaacagataaaacgcttggaaatgcagctcaaaagtcaaaaaaaactgcttgcagagcaaatagataaaatgtaccgagctgagattaattcttccgcagttgaaaagttgttttctcaagaggcacaaaaatctgaacgtatgcagatttattatcgtcagatgaatcaaactcgtttaaagttgattaatgaaatccaacaaactcaagaacagctggagaatgaaaaagcccttattcaaggaaaaagaaaaaatcagcaaaatcagctgacaacacaaaaacaacaacgacaagaactacaaaaattacagcgtgagcaacaattaatgcttgaacagctgaatcaaaatttagtaaaagatcaaaataagttggagcaattaaaggcaaatgaaattgccttgcgtcaacaaattcagcgagcggagaaaattactaaagagaaggaacagcgagagcgggcagcattggcacggaaaaaagagtcggaagaaaggaaaaaccgaaaaccttataaaccgacagcacaagaaaagcaacttatggcaagtaaaaaaggtttaggtgctgcaaaaaaacagtattcttttcctgtacagggtaaagttgtacaaggtttcggtacaagtcaaatgggagaattgaaatggaagggcatggtaatttctgcggtaaaaggttctccggtaaaagtaattgcagatggacgggttattttagtcagtcgtcttgcaggttatggtttaatggtaatcgttaaacatggagagcatgatctcaccctgtacggttacaatcaatctgctatggttgaagaaggacaatttgtgaaagccggacaaaaaattgctgaggttggtgatacggggagttatgcacttccggcactttattttgagattcgtcgtaaagggatacctgtcaacccgatgggttgggtaaaataaaatgagaagaaatatatgtattaaaagtgcggttaaaatcagtcttatggggctaatcctgagcattgtatcgtcttttatttatgctcaacataaactggcgattgtaattgatgatattggatatcgtcttaaggaagataatcagatttattctctgccaaaagaagtttctgttgccattattccttccgcacctcatgccaagcaacgtgatcaacaggcaaaacaacaagatagagatattttaattcatttgcctatgcaaccgcttaatctgcaaaaaattgaagacggtggaataaaattaggtatgtcgcaaccggaagtttatcatcgagtaagaaatgccaaaagtattttacccaatgctataggtatgaataatcacatgggaagtgcggcgacagcggataaagatttaatgaacaaattaatgaccgcacttttgcaacaagatttattctttcttgatagccgaaccattgggcgatcagttgcggggaaaatagcgagagagtttggtatacccactttggaacgtcatatttttcttgatgatagtgataaacttagtgatgttcaacgccaatggaatgcagccattcaatatgctcgtaaacggggaacggctattgtgattggacatccgagaaaaaatacgattgcagttttgcaaatggggataaaacaattaccaaaagatattcaattagtgggtattggcagtttgtggcgtaatgagaagataattcctcagaaaccttttatttatctgtttaatgatatacccgcaccgacatcgcaagcaccatttcaaactattcctttgttaagaggagtaccgaccgatatataatagaaaatacatgattgaagaataaacctctgaaggattttcagaggttggaagttaagggcgaatgtctcgtaagataggattttgcatagaaattaatgtttctgtagattgaatttcatcaattaattgaatttttgtagcaagaactgaatgaagttctgcaatagtatgggtcatgactttaatgaagatagaatagttaccggtcgtatagtatgcttcaactacttcattgatattctctaattgcttgataactttgtcgtaatctttagcactttttaaaataataccgataaagcaacatacatcataacctaatttacgttcatcaatgcggatttttgtgccttgaatgatgccggattgacgcattttttctactcgcacatggatagtgccgggactgacaccgaaatttttcgccatttctgcataaggtgtacgtgcatctttgattaatactcgtaagatttgctgatctaattggtctaaatttggcatatttatttttccttattattcagaattagaaaatatataaaaatattatgctatttttaatataaattcaatattaataaaaaaataaataaatggtattgaattagtggtgtgttttattaaataatacctaacgtgaatttaatattcaattactcgttattaattattaggatgtatgtcatgaaaaaatcatttattttacaacaacaagaaattagttttgctaaaaacacttttacagaaaaattaatcgaacatttaggcatcattgaagttcaaggacctatcttaagtcaagtgggaaatggtattcaagataatctttcaggtacagagaaagcggttcaagtaaatgtgaaacagatcactgatgccaaatttgaagtggtgcattcattggcaaaatggaaacgtcatacattagctcgttttaactttgcagagaatgaaggcttatttgtacatatgaaagcattacgtcccgatgaagatagtctggatcaaacccactctgtttatgttgatcaatgggattgggaaaaagttattccaacaggacgtcgcaaccttgcttatttaaaagaaactgtacgttcaatttatcaagctattttggaaacggaagatgcagtacaccaaaaatttgggttgagtaaatttttacctagagagattacttttatacacagtgaggaacttgttcaacgttatcctgaattgaacgataaacaacgtgaaaatgcgatttgtaaagaatatggtgcagtattcttaatgggaattgggggagtattatcagatggcaaaccacatgataagcgtgcacctgattatgatgactggacaacaccgtctgaaggtgagtatttaggtttgaatggtgatattcttgtttggaatcctgtattggagcgtgcatttgaagtatcttctatgggcattcgtgtagatgaaaccgcattacgtaaacaactggcattaaccggtgatgaagatcggttgcaatttgactggcatcaagatcttgtcaacggacgtttaccgctttctattggtggtgggattggtcaatctcgcttggcgatgttgcttttacagaaaaaacatattggcgaagtgcaatcaagtgtttggccaaaagttgttacagaacagtttgaaaacattctgtagcgtgcttttgaatattatattgaaaaagtgcggtaaaaataccgcacttttttatattaacgctggtgtattcttgatagaatgagcactcacttatgcttaataaaatataatttatgtataactcattttcttctttatttgaacaagttttgcagtctcccgattttatcattttaataaaaatgtctgttgctatgctattgggaggagcaattggcttggaacgagaattgaagcataaaccggttggtgtaaaaacttgtgtgattattgcggttacaacttgtattctgaccattgtgtcaattaaagctgcggaacattatgcacaagtttcagaaaatatccgaacagatccaatgcggttagcggcacaagtcattagtggcatcgggtttctaggtgcgggggtaattttacgtaaaagtaacgatgctatttcaggattgacaactgctgctattatttgggcagctgctggtattggtattgttgctggagccggcttcttttttgatgcttcagttgctacatttatgattttaatcgcagttcgggtaggtccgacgttacaacaaattatccgtcgcagtacacgtagaacacgtaaaactaaaatttatattcaacttagttcaccattgatcatcagtaacgttacggatattttaattaataataattaccgaattgatagtttatctgtcaaagatttacaaaatggagaagtgcgtttaaccattagaggattaatcacagataaatcgaaagtacaaggcgtttatttgttactaaaagatgaagaaggcgttgtcagtattgatttggctaattaaaagaaaaatccagatatttaattgatttgctccaaaagttgtactacatacaccatcaacaaattaaggggtagattttttatgatcaaagggaatagctccttaaaatttttacggtattatgtagcagttgcacaaagaccaaaattcattaaaaaaaaccgcttagaaatgaaatgccctaaactgatttttcagcctagggcatttgttatgacatattgtggctaatacggaaaactcacatcattgttatgctggtgatatttttgccaaaatgcgtgatattgttttttcaccgatgtgtttaataaaaacgggattatcaatacataggtcgggcaattccatagcattgcacgttgtgtatccgtgccgattttggtgcgtaagtaaccaaactgatacattagacccaatccaatcgttatccactctaatagcataataaataaagtcgcatcagtgagtgaaaccagtatcttatggtgtggtagccattgataaagtagcacgcccactactagcattattacggatagcataaaagtatgcctcacctttaactggtgacactggcagcagacagcacaaaaagctagagcatataacatcatcaaagaataaaataaaatcattgttaaccccccctttaatgtgtgttcatcatcgctttttgacctataaaagccctatctaaccaatacttatcgacttcattagagatgataggactctcaaatacttccattactgaatcaatatcctgaatctttttctgtacctgaaagtgagcgtaagccaaactaaagtaaggggttggctcaatttctttattctcgcccttttcatcgtaaggctgatgtaacaacatatcatttgaatcatcttgggattcaagtgattgaggtaatgtatcccacgaaatgccctcttcattcattactttcaacgctatcctatcggctaaggtaggttgattttctaataagcaggtaatcgggtcattggtatcataatcaaaacgaatgccatgaacatcaatcggtgtgatggttttcatcattataagatttcctttgtgttgagggtgattaaacagcaatgtgatagtctgctgcattttcgcttaaactggctattccaaaggtagcaggcggtcttttattgccttgccaataaccgacaaaatgccgtgagggcggacagcttaggcgtttgttgagtaattgggtaaatttctctttctcgcttttacggcgttcatcttcccgccaagcggtttcattcgcatagtgcatcatatagcggttgctgattcggtgatgaacccctgtcatcattcgcctaaatcgagcgaaaaacgattcggcaaggttgttggtgatgccgtctattgagcagtattcttgtgagtgattcactcgttctaaccgataatgaatgttgagcaggccataggcggcattttcatctgcacaaattacgctgttggctttcactaagtgatgcgtgagagcaagaatatcattgccattttcttccttaatcattgccacaatacttttatctgcacctttcattatggattgattggtggctcgttgacggaaaacgattacacacgccttgtctttacgttgattgcgtttggctcgtctatctatccgtctatgtttaaaattctttgggcgaatgtagtaattcacatagcagccatctgaatgtatctcacctgataagggagttaaatctttagtgagattgagcgactctcgcaatttatgtagcaatacccaagccgttttatattgcacattgagtttgtgagaaagcgaaatagccgataagcctgtgctttctgtggcaaacaaatacagagctatcaaaatctgacgtaatgagagtttatgaaattggaaaattgtgcctgtcgtaatcgaaaaacgagtgtggcaatgcttacattgccattgttggcgagtgttagtgaagtaggcggaatgacggacaccgcaatgaggacaaacttgttcatcttccgttccccagcgggcttttttgagtagagcctgtatttctgcatcagcaagcccaaccacttgtgtcagtgacaagtggcgagcgttcgcagataacaggaaatgctgtgccataaaaacaaaaatccctttattgccactctcaattttccaagcctttttagacttaaaaacaatcaaaagttgtaataaagggactattatccgtgccaaaaatgataatagtaacaggggtattgtcaagtgatactttcaagcaaaaattcaaaagtctgtcaagttatttttgatggaatataaaaaataaatttaaattattgatattaaattactattttgtgaaaaataatagagatttggggatttttgtgtgtttaattgatggttttttgttcaatctgattttcaaagattgtatgattattgagctattttgagtgattaggtggctaattctgaggggtatcttgctaaatatttaaggacaacgatagtaccgtttaccatcaataacaagcagattttggtttactaaatctttggtatagaaatgatagtaagcgaaatgattctgcggcataattcgagattcatttattttaaggatttaaaatgttcttgacactatttgctttacaattaacattgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcaacagaatagatctttacaaaaattcgttcaaagaattttttcaactttttgtatgggagtaaaatcctatgcagtctaatcaactctctttatttggtacgcaaccaaaaccaaaaatcctttctcttttttcaggctgtggaggtttggatcttggctttcaccaagctggttacgaaacagtttgggcgaacgacttttctcattgggcatgcgaaagtttccgtaaaaatatcggtgatgtaattgtagaaggtgatattgaacagattaacccaaatgatcctacgattcccgactgcgatattattcttggtggttttccgtgccaagacttttcgatgatttggaaacagcctggcctagatggcgagcgaggcaatctttacaagagctttttacgctttgtgaatgccaaaaaaccgaaagtgtttgtagcagaaaatgtgaaaggtttgctgacagcaaataagaaaaaagccattcaacaaattattactgattttgaaagctgcggttattacgttcaagctaagttgtataactttgccgaatttggcgtaccacaatttcgtgaacgtgtgctgattgtcggcgtacgtttagatactggctttaattttcaacacccaatgccaactcataatgcaagaggtgaaaatgggctaaaaccttacgttaccgcaggtcaagctgtttctaatattccaaacgatgcgatgaacaatgagctgatgaaaattagcgataaaactcgtcaaatgctgtcacttattcccgaggggggtaattttaccgatattccgaaagatcatcctttgtatgtgaaaggaatgattagccacgtttaccgccgtatgcatagagatgaaccatcaaaaaccattattgcagctggcggtggtggcacttggggctatcattttcctgagcctcgagcctttactaatcgtgaacgtgccagattgcaaagtttccctgatgattttgaatttattggctcagctactgaagttcgccgtcaaattggcaatgctgttccaccgcaaggcgtagtagagcttgcaaaagcaattttgcctattttctcggataattatgaaaaagtagatttacacgaaaaattggaaatagaaaaaacagaagtcttccaaaaccgtttaaataaaattcgtggaggaaaataatgaacaccgttttttctaatatcgccaatgcacgtattaccccaaaatctttaaataaagtttggacagatttatttatgtcgtctgatgaagtcctgatgacgactggttatgtttcaaatgatgcagtaaaagaattacacaaaattttggaacataatcaatctattcaaactgttaagctattggttggaatgcactatttagaaggttttagtcagcttcaatatgatagcttgtgtgaacttaatcaatttttgcagcaagaacagcgtggtgcggtttatgtttctccttttgttaaatttcacggcaaaatgtattcattcaaaaatagaaatgaaatacaaggtttaattggttcagcaaatttaacgtgtttttgggataaaacagaaagaacctatgaaactatgtttcatcttgaaaaactacctgcgatctcattaagaacagatattcaaacgacaatttctaaattggggaaacacttagaagaagctaaacgccccgatcattttagagatcataatattaatttagctcaatgtttaggtgtacaaaaggtctcgcctgaacatttggtttcttattttgaaaaaacatctcaatataaatttgaaattcctgcaaaaactgaacctaaaagtaatttaaatgtattctttggcgatccaagagtgggtagaaaagttttgccaagaccctggtatgaagtagaacttattattcctgcgacaattgttcggcaagagggttatccaacgaacagaaaaattcaagtgattaccgatgacggttggttatttccttgttattcaaaaccaaaaaataaaggtgaaaaattatcaacggaaaacttccgttccgaaaacgatctaaaaaccttaggaaaatggattaaaggaagattagaaagtgccaactgtttaaaaacaggcgaaaagatcactgaagaaactctacgaaaatacggtaatgatcattttgaatttcgttcaacggataatcccgatatttggttactttcatttaaggggaaaaactaaatgctgcaaacctatttaaatcaacttacaccacctgaattagctgattctataaaaaacaccgtttccggatttatggataaattggctcaaattgagctaaagaaagcccaaaatgttttattattaggcaatgtacaaagtggtaaaacagcccaagttttaggtgtattaagtgcattggctgacgatggcgatcataaaattttcctttatctgactactgatagtgtcgatttacagcagcaaaccgtaaaacgagctaaagcaagtttggataaatttatcgtcttatcagaagatgatgacaaaagttttactcaagtaatgaaagcagataatccgattttagtagttatcaagaaaaatgctagtgtgttaagacgttggcgaaacttatttaaaagccaagaaaatttaaaaggctaccctctagtgattgtggacgacgaagctgatgcggcaagcctcaatactaatgtaaataaacatgacaaagatgctagtacagtcaataaattattaaatgaaatcaaaaatagctgttgtcaaagtttatttattcaattaacggcaacgccacaatccttattgttgcagcacttggagtctaattggcagcctgattttattcatttctttgaaccaggtgagaaatatattggcggaaattttgttttttccgatccaccaagttatattttccgagcgattgacagcgaattagatgagattaaagatgatagtagcgatattccttatggtgttaaacaggcgttacaatcatttatgattacttgtgcagaatttgatttatgcaataaaactaactgtaattttgcattacacccaagttataaaatccaagatcataaagcatttgcagataaaattaaatcttgtttaaatgagttagtatacgccgtaaataatgatgaaaattttgcaaatagttttaaagaaagctatcaagatttacagaaaactaaacccaatattcatcactttgaagaaatctacgaaaacctgaccgcacttttgcaaaataaacgaattaatgttgttgtgctaaattctaaaactgaatctgattttgatttagaaaaagagtttaatatcgtgattggcggtaatgtgattgggcgtggtttaactattccaaaactgcaaacagtttattatagtcgtacagccaaaaagccaaatgcagatactttttggcagcattctcgcatttttggttatgatcgtgatacatctctgttaaggctttatatgccaacggatgtatataaattttttgtatcgcttaatcaagcaaataatttaattattgaacaagccaagcaattaaacggcaatgtacaaattatttatccgaaaaatatcaacccaacacgtaaaaatgtgttgaaatcagatgcaatcaatcaacttgttggcggtgtaaattattttccatttaagccaaatgaaaaaaatttagcccaaatcaacggattactttctgctattgagcaaaatccaattaaggaagatttatatcaaattgacagtgaaaccttatttttaattttagaaaacctaggtaattatcaatctgatgattgggataaagaaaaatttattaccagtattcaagccttaaaaactcaacgcccaagttttaataattatgttttaatcaaaaagggaagaaaaattggtagagctactggtacaatgctttctgaagatgatcgtaaattaggtgataaatatccaaacgatttgtttttaacactttaccttgtagttggtgatgaaaataaaggttggaaaggcaaagatttttggttgcctaacatcaaattgccacataaaggtttagtttattggggattaaaataacattatgccatctgaatgcaaattcagatggctttttactatattaaacattatcgatttttgaaatttctttaaaagaaatcgaaaaagcttctttgaggttttcaggcattgcacggtaggtatgcgatgagcttttcctcttgattagacatattttcttgggagatggtttggaacatcgtcccattcccagtcagtaaccaagtaatacttattccgaatgcttgacgaattttcaacaatgcttcaacattcggatctcgtccctcattaagataattcattgcagagcgatacgagattcccgtcacatttgagaactccgtcacagtcatatttttagcttcaagaacctgctttaaacgatttgatatgcacattatttcacatttctcttgttaaaagtgaatgattgtgatactttgtgcacaatcaatatgaatgatgtttcatattctagtttaatcaaggtttaactgcaatctcttatgtctcaacattttcttctttccagcaaagcccgcacgcttcgtcattacagatagcccgcctatctgatgacgaagggtttgcgatgctgtgtgaaattcattggggaagtcaggaaaatgtgtgctgcccgaaatgtggcgtacaacataaagcctattttattgccagccgtaagcagtggcgatgcaagcattgtaaccatacattcagcattacatcaggcacgatttttgctaatcgcaagaagtcgttacaaacctatctctacatcattgccaaattcgttaatgtcgccaaaggcatttcttcattacaactggcccgtgatgcgggagtcaattaccgcacggcgtttgttttgtcgcataaaatccgcaaagccttattagatacacgtgatttacagcccatatcagggggaagtcgatatggacagctcttatgtttaccccgctcctcgtaaagaaaataagaaatctgaccgcttggattatcgtttgaaagccaatcaacaccctgataaacgttgtgtgattgtcgctcgtgagcattattcggtaaaagtgtgagagtgtactgcattgcggagcaaaacgttcactggtaatggtggcaaaatccgaaacggagcctgtcgtcaatacgtttgcgaaccgctttattcaagccaatagccgtatcaataccgatgaaagctctgcctacgatgtgttattgccacgttacgatttacgcacggtcaatcacaaggaagaataccgtagcgatttagggataacaaataaccaagcggaaagcctgttcagtcgctttaagcgaatgtattacggacaagtgcataaaatgagtaatgcttatctgctcaattatgcgaatgaagtggcttaccgtgaggataaccgcagaaagccgaatggttggcagtttaatgatatcttagataaatgtttacataccactaatgaaaacaatgagtggtgtggttgttggcaacgcaaaatcgtgcatcaagaggtattgtggcaataatggcaaaatcggtctgcattaatcaaattgaacgtaaaatccgcttattcgagcgtgaacgtgagcaagttgtaaagcatttagcccttgtggacgataagctacaaaagctccgacacgcccttgaggtattagaacatcgccattccgccgataaatacaataccgcctattttacctataaattacatcaacgccatttcaaaggtaagctgcggaagatgttaatcgaagtattaaggcaagaaccaaaccgctattttaccgtgagcgaattgattagcttagtgctaattaaggacggtcaagcagatacccctatcacagctcaacataccgtatcaatgcgtggggcgttaaagcattggttggataaaggcgttgtagaacgccttgaaaagaatgtggtagaagtacgttggaagctgaaacaagaatagcgacatctgtctctattttgcttttcaccgccaatggcatttttcctcaatccaacctttctcaaccaatcctttctccattaaataccgcaataccgtataaaccgtttgggtttgtgggtttggcaaggtgtgtcctatcttttgtccgtctaatttcatcgctcggtgggtaatctcattcgtgttgagccatttatcaggctgtgatttcagtatattggcaactaatttttgtggggaagtaataaaacgagcatttctctctttcttaccagtggaaaatggcgtatttttggtatggttaagggcggtacgataatcagcgagtttttggtaaatatcttttaactgctgttcaagtaaggcgattttcttttcaagctcttcaccctcttgttctcattcagcaatcgctgctatcaaggcttttgataaaatagcctgagagtgtttcattgcgttttccttacctttaggttataacagataagaaaaatgtagcagaaacaaaaaggaaaatctttgtgcaactgctacataataccgaaattttatccttttcacttgagctttatttttaatctctgtataatcgccaaccttacagccatagttaattttcgttccttgcttccgcaagattggtggctggtcttataatcggaggctgattaacccgtaaggagcagtaatgcgtcactacgaaatcgtatttatggttcatccggaccaaagcgaacaagtacccggcatgattgaacgttatacaggttctgttaaagaagctggcggtcaaatccatcgcctagaagattggggtcgtcgccaattagcttacccaatcaataaattacataaagcacattatgtgcttatgaatgtagaagcgcctcaagaagtcatcgacgagctagaaacaactttccgttacaacgacgcagttcttcgtaacgtaattattcgtactaagcacgccgtaacagaagcgtccccaatggttaaagcacgcgatgagcgtaaacctttagctgaagttgaaaacaacgattttgaggatgctgaagagtaatttaactgttagtaatcgtttctctttagtcggtcaagtggcagattatccgaaacgatataaaagccctaacggtatcgaacattgccggttttatttggaacatcgttccgaacaacgagaagccgggttatcacgtcaggcgtggtgcaaaatggccatacaagttagcgggaatgcactaatagcaaaagctcaaagcattacggtcggtcagcaattattgattgtgggatttattaactcacataaatcggcaaacggtttaaatcaattagtattacacgccgagcaaatcgaatttatagattaggagaccagccaaatggcacgttatttccgtcgtcgtaagttctgccgtttcacagcggaaaatgtagtagaaatcgattataaagatattgctacattaaagaactatatcacagagagcggcaaaattgttccaagccgtattaccggtactcgtgcgaagtatcaacgtcaattagctcgcgctatcaaacgtgcgcgttatttagcgttacttccatacactgacaatcatcagtaatttaaggagaatacggtaatgcaagtaattcttttagataaaattgctcatctcggtaacgtaggtgatcaagttagcgttaaagcaggttttgctcgtaacttcttaattccacaaggtaaagcagttatggcaactcaagctaatattgaatattttgaaagtcgtcgtgctgaattagaacgtaaagcagcagaagttctagctacagcacaagctcgtgctaatcagttagcagaattggcaactgttactattacatctaaagccggtgatgaaggtcgtttattcggttctattaccgcacgtgatgttgctgaagcagtaactgcggcaggtgttgaaatcgctaaaagtgaagttcgcctttcaacaggaccacttcgcacgaccggcgaacaccaagtccgtttccaattacacggcgaagtatttgcaacattaaatgttgttattgttgcagagtaatcattaaaattataatgacagaacccaacttttatgttgggtttttttatatctttgttgccccaagtaatcttatagctaaattctttaactcatacattaatccacgtatttttctaacataacattattcatttctattttttatcctttatcctttatcctttatcctttgacaaccttagtagctttaattcaattataataacgcgctgttttcttactaactctttgagaaatagtaatctccgataattcctgtaatgatcatgggcttattgtaatctctgctgttgtgtatgggatattttaaaatctaaataatccgatacggtgtgccgtttcttttttgggtataatctgtcaatcttcttttactaaaggagattattgatgagtaaatcaaaagtaatatgaatccgatatatatggtgctacaataagtgcggtgcatggtgcatggtgcatggtgcatggtgcatggtgcatggtgcatgctttgatataatatattttgagtgaggaatttgcgatgtcctatttagaacgtgcaagagagctttttgatgaagcaaaagcagtgagaagacaaatccatcaacaccctgaagtgggttttgagttgcccgataccatggcgttgattaagaaaaaattggatgaacataatattcagtatcgtcaattggacgatgcctatgctctagtggggacgttgggcgatccgagtaagggtaagacgttgttgttgcgtgcggatatggacggcttgccgatggtcgaagaagcgaatttggaatttgccgccaaaaatcaatgtgcacatttgtgcggtcatgatattcatgcgacaagtttattggttgccctgatcatgctcaaagaagatgaagataagttgcaagggcaaatcaaatttttattccaacctgccgaagaaacgctgaatggtggtaagttgatgatcgaaaaaggggtgttggaaaacccaaaaccggatgctggtctagcactccatatgtggcctaatggtgaaaaaccagggattttgataaataaagaagctgcattggcatctgcattgaattttaaaatcgagattaagggcaaaggggcacacggtgcgatgccttataacggtgtcgatcctgtgtttgtggcttcgcaaattattaacggtgccaacggtattttggcacgtgagttgccttccagcaaaggggcttctttatccataggatcgatcagtgcaccgggcggggcaatcaatattgtgcctcctaatgcgtatttggaaggaacttcccgctcgttatacgatgattcggctaaacacatggcaaaacgattgcctgaaattgtcgagcatatcggtaaggcattcagagccgagacagtctatgaggaagtagcgaatgtgcctgcgttggtcaatacgcctaccatgtctgagttggtcaaggcgtcggcagaagaagcattaggttctgaatatacggtgaaatatattgatcctattttagcgtccgaagactatgcccatatcgccagtcaattgcctgaatcctgctatttctttgtgtcttgcccgcaaccggatgcggacggcaatgtctatgcggtacaccaccctaaagtggtcttcaatgaagaggcattgattatcggccctgcaactatggcacaagctgcggtgaactggttagcaagtcatcgttaagggggtgactcaatgagccagtgtggtgtgtattgaaatatcaatcccattggcttttttgtttttgaattaaaaatatttcattcaaagttttccgtcaatatccgctttgggatcccttgccatttaaaaaattaacccaagcggttttttttgcataaacagaaaaaagttgtagcaattattacatcaatatagacttgttccgattttaactcattgatattttagttaatctaaaaatttatggaaataaaatagccatgaaaacactcagtcaagccgctaaagtagtcacttttttacggcaaaatccacaacaaaaattcaccgctcgccaaattgccaaagcgattactgcgcaatatccgcacgattatcaagagaaaaaagccaactttacggatgaagggaaatttatgcaacaaattgtggcggaaattggttcacaaaaagatgccattttaaaacgttgccccgacattcaaatgcaggataaaccgcgtccgcgcttattttggtatgaaacaggaaattcaacaaaaggtgctttttctgaaaacacttttgttcaagtcaacgataaaaaaatctctgaacatgatgtgtatcctcaactcatgcaatttttatcacaagaattgaacttgtactgtttacggattgatgaaaaacgctctaaaaacaatcgtggccacaaaggtaatcaatggctacaccctgatattgtcgctatgcaagccttggataaacaatggacacaagatattcaagattgtgctaaattgggttcagggaaaaatgtggtattgtggtcgtttgaagtaaaatgcgaattaaacggtggaaatgtgcgtgaaagttttttccaagcggtcagcaattccagttgggcaaatgaaggctatttggtgaccaccgccattgttggtgaacacaccgaggaagaattgcggattttgtcggcattacacggcattggtgtgataattttgaatttagacgatttaaacgaaagcgaaattttattgcctgccaaacgcaaaaccgaaatagattggcaatctgctaatcgcattgtggaacaaaatacggattttaacaagtttattgaatacgttgccatttattataaaacaggcaaaattgttaaagagagttggaataaataaaacatgattaccaaacacaaccttcccgaattattaaaccatctcggttttaccgaacagaatcaaatctaccgcaaagtttttcatgggcaatatgaattaagcgtggatttcaaagcagaaaaaatccattatcccaatggtttaaccgccgaacgcgacaccacgctcaatttcagccagcctgaaaatttcgtggtgttggaatgcgtgtgccacttattgcaaacgagttacacgcccaatcaaatcgttttagagccgaaaatgacaggcggacgcgaagacaccagtttttattgcgatattttattgcgcgataacgaccacacgccctatatgttgattgaatgcaaaaccaccgacaacagcaacagcgaatttgaaaaagcatggcgcaaaatgcaaaaagacggtggtcaattgttcaattatttcaacagctaccgcaaagcacaatatttatgcttgtatgcttctgactggaatggcgaaaacgtagaacacagctaccgccttgtttccatgaaagacaacaccgaatatttaaaaagcgatgaaaaattgattggttatgagcaaattcacgcagaaagtggcagcaaaagcgatttctttgaagtttggaaaaacacttaccaactggacgcaacagaacatcaattatttgaatctgcaccatttaatatcggcacacgccccttttcagccagcgatttgaaagtggtggataacaccagcattcagaaaaaataccaccaattcgccaccattatgcgccaacacaatgtttcggggcgcgaaaatgcgtttgataaattggtgaatttgtttctcgccaaaatcaaagacgaaagcgaaaacccaaatgaattaaaagtttattggaaaggcgcggcacaagataattattttgacctgcaagaccgcctgcaagcactttacaaaaaaggcatggacgaatttttgggcgaagaaattacccacgttaccaaagaagaaattgaagccgcctttatcttattcaaaaacaaaaaagacgaaaccaagaaaaccattttggacaaattcaccgaaatcaaatattacaccaacaacgatttcgcctttttggacgtacataataaaaaactgtttttccaaaacggtgcaattttaaaagaagtggtacagatgctacaggacattcgcctaaaaaccgacaatggcggcgaaaatcaatttttgggcgatttgtttgaaggtttcctagaccaaggcgtgaagcagtcggaagggcaatttttcacgcctttgccgattgtgcgttttttggtgtcgtctttgcctttggcagatttgatttcaggcagcgatgcaccgccgaaaatgattgactatgcttgcggtgcggggcatttcttgaatgaatacgccagccaaattcgcccattggttcaagcatttaaacaagcggacaccgcaccttattatcaagccatcgtcggcattgaaaaagaataccgcctctccaaagtggcgaaagtttccgcgtttatgtatgggcaagacggcattcagattgtctatggcgatggtttgactgcacacaacgataaagtgaaagtggaaaatggtgcgttttcggtgctggtcgccaatccgccgtacagcgtgaaaggttttttggacacgctttcagacgatgagtgcaaatctttttcgctttacaaacatgtggataaaaccgatacctttaattccattgaaacttttttcattgaacgcaccgcacaattgctccaacaaaatggcgtggcggcgattattttgccgtcttctgtgttgagcaatggcaacatttacatcaaagcacgcgaaattttattgcaacactttgatattgtggcgattgccgaatttggttcaggcacattcggcaaaacaggcaccaataccgtaaccctgtttttgcgtcgcaaatcagacgcacccagcttgtccgcacattaccaaaaccgcgtggatttttggtttagcaatgacaagtccgccgatgaattgttccaagacgcacatttattgcagcaatattgccaacattgcggtttaaattggcaagattatcaagactttttgactttcaggctgcctgaaagcggtattttcgccgattaccgcgaaacttatcgccaaagcactgattggaaacaacgtcaagccaaacgcgattacaaagcactttccgatacggaaaaagcagatttgtttgaacaaagtgcgtgggcgtttgcgcgtgaaatggaaaaagacaaattgcattattttttattggcttatgccaatccgcagcctgtactcatcatcaaaagccccgccgacaacaaagaagcgaaaaaattcttgggctatgaatggagcacacgcaaaggcagcgaaggcatcaaatacatcggcagtagcgaagcggaaaacgaagaaaaccccaaccgcaatcaaggcattttcaaaatgcacacgccacttttcaatccgaatgatttgcatgactctagcaaactcaatcacttaatccgccaaaattttcaggccgcctgcacgcaaacgcagcctgaaatcagcgaagatttgcgcccatttgccagcttgcgtcctttgcatgaaatgctggatttttcgcgcacggtgtttgataaagccattcagacggcattggtggagaaagtggaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccattggatattcagcaacaaatcattgccgaatgccaaaaaattgaccaagaatacgaaaccagccgcatggcgattgaaacctatcgtgccaaaattgcccaaatattcagcgatttagaagtgctggcacaaaattcatcgaggggggggtaaaactgtttaaaatcaaagatttatgcaaaacaaatccttcaaaaaatattttgagggatttgcctgatgacttgattgtttcttttgtggaaatggcatcggtcagcaatgatggttacattcaacaaaaaattaaccgtccattgggcgaattgcgtaaaagcagctacacctatttccaagaaaatgacatcattattgccaaaataacgccttgcatggaaaacggtaaatgtgcattagcaacagaattgagcaatcacattggcatgggtagctcagaatttcatgttatccgctcccaatcaccaacattgaataatgcttttttattccattttttaaatcggaatgaaattcgtcaatcagcagaacaacatatgactggggctagcggtcatcgccgtgtaccaatcgggttttatgaaagtttgccagttcccgtgccaagtattgagaaacaaactgaaatcctcgcccaaatcgcgcaatacgaagcccaaatcgccacttgcgagcaaaaaatccaatctttgcccgctcaaaaacaggcaattttggtgcagtatttgcagtgatgtaactttcagacaacctgaaaaataaaggcaggtaaatatccgaaaatgacttaattctttacacgaccacagacattcaagcccaatttttgttatacgaattgggcgggtaattgtggctaacgcaagcataaattgccgaactggtcaaattaagaaaaaaacggcaaccctacctcatttcttcctgaaagtgcggtgttttttagcgataaaaatcatttcgttgattaaaaacttttcatgaagacaaaatatgtgattttttaaatgaaaaaatcgctatttgcaatgccgtttattgaatcaaatggttacatatcaatgctatcgttttttttgtttttgaatgtgaaataatgaagcgataatttgatttaatttatgtattgttatttaatatgcctatccgttggtaacggcgattattttattaagcatgacattacacttgctgtctacactgtcaataaaacacgtttatgtgatggtctggggagtattttatgtcttgtttttgtgtgttgttgtaatctgtatatgagttttttttggagtatctataatggaaccatcctaccaggaacaaaacaattgtactgaaacgattaaaatcaatgaagtcaaaaaactttggttggacagtaaattttcccttaatttacctgtatggacattgttgttgcctttatttgcattattagtattggcatttcatttgctgactcacccaacaggctggttgattaatactgttactacggttttgcttatcggttcggtatttgctgcagtgcattatgctgaagtgattgctcataaggtgggggagccgtttggtacgttggtgcttgcaatagcggtaaccgttattgaagtggcattaattgtgatcctgatgagtaacagcacgcaggaaaattctttggtgttggcaagagatacagtttatgcggcattaatgttgatttgtaatgggatcgtgggtatcgggctgctgataggcggtatgaaaaattatgtccaattatttagcttgcacggtattaaggctgctgtcagtgttttactggcaatttcattaattgtttttgtgttgcctaattttacgctttctgccgagggtggtggaatggtcaattcacagctgttgtttgtggcaatgtgctgtttggtactttacggctctttcatttttacgcaaactattcgccatcgtaattattttgttgatgaggatgaaaatgaaagccatcacaacgacaattggttaacaattggtgtgagtattgtgtttttattgataagtttagtttctgtggtaggactggctaaaatgctatcgcctactattgagtctgcactaattagtttcggattgcctaaaataatgttggggattatcgttgccggtttggtattgttgccggaatcaattgcttcaattaaggccgcctataataaccagttgcaaaacagtctgaatcttggtttgggttcggcattagcgtctatcgctttaactgtgcctgtgattgcgattatttctgttatctccggtcagcctattgtgtttggtttaacagccaaagaaagtttaatgctgattattacacttttattgacaatgaatactttaagcacaggacgtagcaactttttgttgggagttattcatttggtaatgttggcaacttttattttcttttccatcattccttgattttgaaatgaatgatttacatcagtaagtacgaagagaaaatcaatcacattattatcgggcagaaatatatgaaaaatagaaatttttattttggattgggttttattgctttgcttaccattatcgtgagttggttagcaaatactcaatttgcacatcaagcgaaaatcagtgctttgactatcgcaattttgttaggcattttaattggtaataccttttatcccgcactttcatcaaaactggacaaaggcgtgttatttgccaagggaacattgctacgtattggaattatattatatggcttccgtttgactttgcaggacattagccatgtgggaatcaatgccattgttacagacagtgttatgttgctttccacttttttccttgccgttgggataggaatttattggcttaaaatggacaagcagacggtgtatttgacggctggaggctgtagcatttgtggggcggcggctgtgatggcaatggaacctgttaccaaagccgaatctcataaagtatccgttgctgttgcggtcgttgttatttttggcacgattgccatgtttctatatccgtttgcctatttttatttacaacattggctaacagatcatcaatttgggatttatatcggttcaacggtacatgaagtagcacaagtttatgctgccggcggtaatattggtcctacggttgctgatacagcagtaatcaccaaaatgattagagtaatgatgttagcgccatttttattagttttatcttgggcattatcaaaacagaaatcagataaaagtaaaattaatattccttggtttgctttcttatttattctcatggcaatctttaattcctttgatattttgccaaaaagtgcggttaaatttattgtaaaattagacgatttactgttaattgccgcaatgatagctttaggattaaccactcatattagtgctatcaagaaagcgggtgtaaaacctttattattaggtatgttgctctttatttggttggttttaggaggattagcagtgaatttgttaatgcaaggatttttataaagataaggatattattttgaacaatcttactgaaacgtttactcttgaacctcaagataatgcacgcttacaatccctttgtggcacatttgatgagcatttgcaattaattgaaagcagttttaatttggttgtttcacgccgtaattttacttttactgtacaatccgcagacggagaagaaaaaaacacgtatcatccaactttgctaaaaagtgcggtgaaattaattaaaaatttatatgctgacactgcaaaaattcgtggcaaagtgaaagagctggatttggaagatatacatttggcaattcaagagagccgaatgttattacaagataatactcaaacaaagcgggaagatagtaaagtttatagcacaacaattaaaactaaacgtggcttaatcaaacctcgtggtaaaaaccaaattgaatatttacataatattctcacacacgatattagttttggtattggaccggctggaacagggaaaacttttttagccgttgccgcagcggttgaagcattagagcgtcaagaagtgcgtcgtattttgcttacacgtcctgctgttgaagccggtgaaaaattgggttttttacccggtgatttaggacagaaaattgaaccttatttacgtccgctttatgatgctttatttgaaatgttagggtttgagcgtgtgcaaaaattaatagaacgtaatgtaattgaaattgcaccgttagcttatatgcggggacgaacgttaaacgacagttttattattttagatgaaagtcaaaacacaacggttgaacaaatgaaaatgtttttaacccgaattggatttaattctaaggttgttgtaaccggtgatgttacgcaaattgacttacctcgtagtcaaaaatccggtcttcgccatgcgattgaagtattagaaaatgtgccagaattaagttttaactattttgacagcaaagatattgtacgtcatcctgttgtggcaaaagttgttcaagcttatgaggtttgggaaattaaagatgagtttcgtcgccaacaattagccgagcaaaaacaacaagagcggttagaaaaagagcagtttaccgaagaacgggtaaaagcgttacaagaataattttatacaaaggttcaattcatgaaaaatgtcattattgacctacagatagcgagcgaagatgcgaccaatttaccaagtgtggaacaaattcaactatgggcaaatgcggcaattcgagcggaaaactcacaacctgaaatgacagtacgcattgttgatgaagaagaaagtcaccatttgaatttaacctatcgtggtaaagataagccgactaatgtgctttcttttccttttgaatgtcctgatgaaattgaattaccattaattggtgatctagtgatttgtcgtcaagtagtagaacgagaggcgacagagcaagaaaaaccactaatggcacattgggcacatatgatcgtacatggtagtttacatttgttaggctatgatcatattgaagatgatgaggcggaagaaatggaaaggttagaaacggaaattatgctttcgttaggttttactgatccttatattattgagaaataaccaacctgaaatgatatcttctcgccatgtgcaaattagtattgcacccaatctgcaaggttttggaccgcactttttatcacattttgatgttttgtggttagggtgggaaaaacccgattttaatgtgcatttttgccatgtgcaaaaagcaaaaaagttacttgggcaagagtttttaaatgtgatttttgatgctcgtcagggatttcatttagaaagtttggcgattgtggcgggaacgataaaagcaggtggaacattaaatattctacttaatcattgggatcttttagaacaacaggctgatgttgatagcttgcgttggagcggtgtagaagaaatgattgcaacaccgcactttattcggcattttcaacggattgttaatcaatttcagtttcctgttaatcatttcgctattccagcgattactcaaaataacctatctgatttattttgttcagttcaattgagtgcaactaaagcacagcaaaaagttattgacagtattttacagcaacaggcagatatttattttttaacagcaaaacgtggacgaggcaaatcagcattattgggtttgttatctcaacaagtaaaacagaaagtttatttgacggcaccgaataaaagtgcggtgaatattttgcaaaagttcgccggtcaatcagttacttttattgcacctgatgagtttgttcaccgtttggtagaaaatccgcaagaatatcaacatgcttggctatttgtagatgaagcagccatgctacctgtcagtaccttaaatttttttagtgcttattttaaacatattgtttttagtacaaccattcatagttacgaaggtacggggcgtggttttggcttaaaatttaagcaacgaattttacaacaacggcgaaaatgtcttgaatttgaattaaaggagccattgcgttggcgtgaggatgacaagttagaaccttttattgatgtgcttttattgcttaatagcgaagatgattttcggcaatatcattacaaatccaatttggacgttcacataaaatcgctaaatcaacaggcgttattgacacaaatagcagatttttacggtctattatctttagcacattaccgcacttctcctattgatttacgtcgtttattggatgctccaaaacaacgattttatttggcacagacagaaggacatttgctcggtggaatatgggcattagaggaggggggattgacagatcgaggattgattgcggcgatttgtcgaggagaacgccgaccgaaagggaatttagcagcacaattattggcttttcaatatcttaattcacaggcttgtgaattacgttctttacgaatttctcgcattgcacttcaacctaattggcagagaaggggagtagggcgagatttgatagctgctttgaaagtagaaagtaacattgattttttatcagtgagctttggttacagctcggagttggtttctttttggcataagtgcggttttaatttagtgtatttgagtgagtataaagaaagtagcagtggcacatataatgcaatggctatttgtcctttgactttgcgaggcaaagaattttcacaacaatgtatgagtcaatttagacgagattttgttttatcggatcatcctttattgaatgagattataaataatcaaactattgaggtagagttaaatgcctttgatgtatactcattgcaaaattttgcattttattaccgcactttatcggctgctcgtcctgccttatggagactattgaagatgatagctccctctgattgtcctgtcttgaggaaatatttttgtggtgaaaaagatttcttgtcttatggcggttatcgacaaggagtgataatttgccgcaacgaagtaaaagaagtgttgcaaaaatataaaaactttctatgatggagtgatttttatacaggaaggagaatgtgatgccggatcaatcagaaaagaaaggttttttccgccgtatgctggatgcgtacaatcaattttgtaatgaaatggaggtggataaagggacttgtcgaggctgtgtacctatagtcaaatttgatgaaaatgcaaaacaagaaacagataatgaggctggtaaagcatcataattgtgaagtacttcacataatggaaaagatttagccaaccaatgtatccatcttagtttacttaactataacaactctctaaaatacgcacgctttacttcagtgaagttggcgtatttttattattatttttaggtgattattatgttatggtttttcttttgtgttgccctattgattttaggctatttcacatacggtaaatttgttgagaaagtatttgttatcaatccgaacaagaaaacgcccgcttattctatgacagatggtgttgactatgttccgatgtctaaaaagaaaatttggctaattcaattattgaatatcgcaggcacaggtccgattttcggaccgattatgggggcattatatggaccggtggcgatgttatggattgtactgggttgtgtatttgccggtgcagtacatgattatttctgtggtatgttgagcgttcgtaatggtggtgcttcaatgcctactcttgccggacgctatttaggtactcccgttaaagtatttattaacgtacttgccgttgttttattattccttgtcgggattgtgtttgtaaccagtcctgctcagttattaagtactattactttagatatgtttggtagtgcaagtatggctacaaccaatgcacatgaggtggtaagtgcggtacaaaacgctggtgagatccgtgtttggggaatggataaaccgacagttgtggcggtttggactggaattattttcctttactatattgtggcgacattgttaccgattgataagattattggacgtatttatccattatttggtggattattattattcatgtctgccggtatggtatatggcttagtatccagccatttaaatggtgctgatccaattgaatttttccgttccgttgatggtatgagttttgaaaaattcttacaaaactttgaaactcgtaaagagctaccattatggccattattattcttaaccatttcttgtggtgcactttccggtttccatgcaactcaatctccattgatggcacgttgtgctgaaaatgagaaagaaggtcgttttattttctacggagccatgattgcagaaggtgttattgctttagtttggtgtactgttggtttaagtttctatgaaaatttgggtgaactattagctgcaacccaacaaggttcaccttccaaagtagtgtatgattcttctatttatttcttagggactattggtggtgtttttgctgtattaggggtagttgtgctacctattacttccggagatacagcattccgttccgctcgtttgattattgcggagttcttaaaaattgaacaacgcactttggtgaaacggctacttattgcagttccgttatttgcagtcggtttttggattattgcatcaaaaattgactttggtgtgttgtggcgttatttcacttgggcaaaccaagcaacagcaatggtgatgctatggacagctgcggcttatctatatcgttacaataaattccattgggtgtgtactattccggcagcgtttattagtgcggtatgttttacatacttagcctataacaaaattggttttggtttagattatcaactttccgtttatattggtattggattaactattttgtgtttagtggctttctttactttattgaaaccgttaggttcgaaagatccggatgcctttataaatgatgtaacataattcataagtaatagataaaaaaccgttcgaggcaacttgaacggtttttttataaaaaatttactttatttatatgttttcaagataaaaaacttgcaacctaatctcactggtaatacacttatgaagtggtaaaaagtggaattttgtggagaaatttgtcataatcttcctcatttatctacgatcaataattttttgtgattaaagtaaggaaacaatatgtttcgaggggcatcagcggttaatcttgattctaaggggaggattgcaattcctactcgctatcgtccggaaatcctcgaaataaatcaggggcagatggtttgtaccgttgatattcgccagccttgcttattactttaccctttaaaccaatgggaaattattgagcataaattatcaaaattgtcgaatttcaatccggaagagcgtagtttgcaacgtgtaatgctaggttatgcaactgaatgtgaacttgacagtgccggacgaattcttattagtgctcctttacgtcaacatgcaaaattagaaaaatccattatgttggtggggcaattaaataaatttgaaatttggagcgagtcagagtggcaagctcaaattgaaaaagatatgacattaggtgcgagtggacaatttgccatgtctgaagcattaagtatgttatccctataataaaaaagatacgttacagtcagtaacggtactagcaaaggtaaaaaggtacgttttttgttgtaccttttatcccttttgattttattgatttttcctaggttattgcaaatgagtatgcaagatacattttcttcacctgagcatttcactgttttattaagagaagcagttggcggtttagccttaaaagaaaatggtatctatattgatgggactttcggtcgaggcggtcattctcgttttatcctttctcaactgtcaaaaaagggccaattaattgcgattgatcgtgatccccaagcaattcaggttgcacaaaatattcaagatccacgttttcgtattgtgcatgacagcttttcagctattccggatatttgtgaaaaattaggattgacgggcaaaattgacgggattttacttgatcttggcgtgtcatctccacaacttgataatgcggaaaggggattcagtttcatgaaagatggtcctttggatatgcgtatggatacgacacaaggattatcggcaacggaatggttgaggcaggtttctgaacaggatttagcatgggtattgaaaactttcggtgaagaacgctttgccaaacgtatagctcaggcgattataggatataacaaaagtgcggtgcaaagtggagcagaacctttaaacagaactttacaattagctgaactgattgctcagtctgtaccttttaaagataagtataagcatcctgcaacgagaagttttcaagctattcgtatttttattaattcagaattagatgaattagaaaaagtattgaatggagctttaaatgttctcgctccccgaggacgcttgtcgattatcagctttcattctctggaagatcgtatggtaaagcattttatacgtaagcaaagcaaaggtgatgatgtacccaaaggattaccgttgcgtgacgatcaaattcaacataatcaaaaattaaaacctattggtaaagcgattatgccgacagaacaagaaatggctgctaatgttcgttcaagaagtgcggtcttacgcattgcggagagaatataatggtaagagatttcgaacgctacccattgtataaagttatttttgaggacttggtttctgcaaataaattattaattgttttaacgattttggttgtattgagtgcgttaagtacagtttggattactcatcaaactcgtattttagtcgctaaaaaaagtaatttagttgttgaaaatcaatcacttgagcaagaatatttaaatttaagattagaggaaaaggcccatagtcttcattccgatatagagtcttttgccactcaaaagttgaagatgaaatccgttccggctgaacaagaggttgttatcattgaatagataatagatattaggcggttattaatgacacataataagataaatcgaaaaaacaaacgagcatttgaaaatggtgcaaagcgtaatcaacctaaaaagatctatgaaaatagtttcttgaaatggcgttttatggttgttgttggtcttattattttatcactcacagctttagtgggacgtgctacttatgtacagatgattaaatccgatgtgctatctaatgaggcggatgaacgatccttgcgtaaagaaaaaattttgtctatgcgaggtaccattgttgatcgcaatgggcaacttttatcagtgagtgttcctatgttttcaatttcagctgaaccaaaaaaaatttttagtaaaaatggtttacaagatgaggaacgctggcgtgcattagctaaagcattaggtatgtcttacaaggacttacgaaaaattctagaaaaaaatcctaaatctagttttgtctatttagctcgtcaggtgtcaccaaccattgcggagtatgttaaagaattaaatctatatggagttaacttaaaaactgaacctcgtcgtttttatcctaagacagaggaaactgcacatttactcggctataccaatatagacggggaaggtattgaggggatagagaaaagttttaattcatttttagttggtaaacctggatcaagaacagttcgcaaggataggcatggtaggattattgagaatatatcagatcttaagaaatacgatccgcaaaatgtcattttaagtattgatgaaaaattacagtccgtagcttatcgtgaaataaagaaagctgttgaaaaatacaaagcggaatcaggaacggcagtacttgttgatattcatacgggagaggtgttggctatggctaatgcaccttcttataatccaaatatacgcacaagttttaagactgaagtgatgcgtaatagagctattacagatactttcgagccaggttcgactattaaaccttttgttattttgaccgcacttgaaaaaaaagtagtgcgaagagatgagataatcgacactggtcgtttagttttagatgggtatgaagttaaagatgttgcagtcagagatcgccaaacgcttgatcaaattttagaaaattcgagtaatagaggggtgagccgtttggctttgcgtatgcctgcaaatgcactaatagatacatataaaaaagcaggtttagggcaacgaacagaattaggtttagttggggaacaggcaggtttcttgaatgccgatcgtaagaaatggtcagatattgatagagccagtgtttcctttggttatggcatcagcactacgccgttacaacttgctcgtgcctatgttaccttgggcagtttcggtatttatagacctctttcaattacaaaagtagatcctcctgttattgggcagcgagtgttttctgaaaaaatgactcgtgaagtggttaatatgatggagaaagttgcgataaaaaataaaagagcaatggtagagggttatcgagtgggaataaaaacaggaacagcaaagaaaattgaaaatgggaaatatgttaacaaatatattgcttatacagccggacttgctccaatcagcaaccctcgctatgccttagtggtattaattaatgatcctaaaggtagagaatattatggtggggttgtttctgcccctgtattttccaatattatgagttatgctttgaaagcaaataatattcctcctgatagtagtaactatacaaaaactgttagacgtacagtttatctcaatagtcaagagaataaagcgaacgccaattaatcattcaggtaatctatgaaaaaattaaccgcactttgggatattgatgaacaattagatagcgttcatagagatattgaacttcaagaaatgattttagacagccgtttagccaagaccggctgtctttttgttgcgattaaaggacatcgtgttgacggtcgagaatttattatgcaagccattcaaaatggagcaagtgcggtgctgtttgaaactgatctagtggagcagcatttgaaagtaagctttgagcaaaatattccgcttattgcgtattatgaactgtcaaaacatctttctcatattgcagatagattttattcatctccttcacaacgtttaacccttgttggcgtaacgggaaccaatggtaaaacaaccatagctcagttacttgcacagtggacacaaattttagggcatacaagtgcggtcatggggacgattggcaatggtttatttggacaaataaaagaagcttcaaatacaacgggatcggcaatagaaatacaatcctcgttagataaatttattcggcaaggtgctgattttgctgcgattgaagtgtcttctcacgggttagtgcagcatagagttgaggcactgacttttcgtgcaggcatttttaccaacctaagccgtgatcatcttgattatcatcataccatggaaaattacgcacaagcgaagaaacgtttgtttagtgaactgaattgtcaacataaaattttaaatgttgatgatgaaatcggggcaacatggttgattgaattaagtaaagatgatcctgatgtggttgcagtaagttgccgtgcggattatcagcccgatacaaaaaattggctaaaagcaaccgcacttagttttcacagcaaaggcacaacgattgaatttgcctcaagctggggaaatgggatcttaagtagcccattaattgggggcttcaatgtgagtaatttattacttgttttagccacactcttatcgcttgggtatgacatagataaattacttgctacagtacggcaattaaccggtgtttgcggtcgaatggaaatgttgagtgcaaaacataaggctaccgtgattgttgattatgcacatacaccggatgctttagagaacgctttgcaatctgctgcagttcattgtcagggaaaactttggtgtattttcggttgtggcggtgatcgtgatagaggtaaacgtccattaatggcagctattgccgaaaaatttgctgatagtgtgattgttactgatgataatcctcgaacagagaatcctgaacaaattatgcaagatattttgacaggttttcagcaatcaagtgcggtgcagattattcatcagcgtgagcaagcaattaaaacagcgttacaaagtgcggtagaaaatgatgttgttttgattgctggaaaaggtcatgagaattatcaaattattggaacaactaaataccatttttcggatcaggaaattgtaaaaaagtatttttaagtttagtaaaatttgaagtcattgatgagtaaaatacagaaataattcattgtattgaatgatgagaagtaagaaataacatgattaagttatcgacaaaagaactggctgacattttttccgcacgattaattggagcggaggatatttgtgtggaaaaggttagtaccgacacaagaaagccttgtttaagaagtttgttctttgctttgaaaggtgaaaattttgatgctcatgattatctgacacaggcagtagaacaaggttgttcagctgttgtagttgagcgtgagtgtgatgttgatgtaccacagttaattgtacctgatactcgtcttgctttagggcaattagctaaatggctaagagtaaaaattaatccaaaaacaatcgcaataacgggatcttcaggcaaaacaactgtcaaagaaatgacagcttctattttgcaaaaagtggcacaagatcctgatgcggtcttatttactcagggcaattttaataatgatatcggtgtgcctttgaccttgttacgtcttgagtcgaagcataagtttgctgttattgagttaggtgcaaatcatcaaggtgaaattgcttataccgtggatttagttcaaccggatgtggcattggttaataatgttgctgcggctcacttagagggatttggaagtgttgagggagtggcacaggcaaaaggcgaaatctatcaagggttaagtgaaaacggcattgccataatggaatatgagcattctgtgctctggaaaaaatattggtatgaacaaataggtaatgcagatactcgattgttttccgttatggggaaggtgtcggattactatgcacaagaaatcaaattaacggaaacaggcagtcagtttacattgtgttgcatcgaggaaggagaaattaagattaatctgccttatttaggattacataatgtcagtaatgccgtagcggcagcctcattagcttcatgcttaggtgtgagtttagaacaaatcaaagcaggcttagaaaaaaaatcgtatgtaaaagggcgtttatttcccattgagccttgtccaaatctattgttattagatgatacttataatgctaatgtaagttcattgaaatccgctattgatgtattgcgacaatatgataaatttttccgtatttttgctgttggtgatatggcggaattgggggaaaattcagtgagttgtcacaaacaagtagcggattttgctcagatggcgaacttagatttagtggtcagttttggtacacaaagtgcggtcatttccgatgcttgtgatggcgttcattttagtgataaaaccgagttagtgaattatataatccccattattcagcaaaaattagccggtcaaaaagttgttttattagtcaaaggggcgagatgtatgcaaatggaagacgtgattaatttagtaaaggataaatttcaatgttagtgtggttagctgaatatttacaccaatatcaaagtgtatttaatgttttttcttacttgacagtgcgtgcaattcttgcacttttcaccgcacttttactctcgctatggattggtcctaaagtgattcgtcgtttacaaattttgaaatttgggcaagaaatacgtaatgatggtcctgatagtcacttaagcaaaaaaggcaccccaacgatgggcggtattatgattttatttgctataggggtcagtacgttattatgggcaaatttagccaatccttatgtttggttttgcttgtttgtattatttggctatggtgcggtcggttttgttgatgattatcgtaaaattacacgcaaaaatactgccggtttagttgctcgttggaaatatttttggctttctgttatcgctttagtctctgctttcggtatgtatgcgataggtaaagatacggatgcgacacggttggttgtgcctttttttaaagatgtcatgcctcagttaggtttgttttatattgtattggcatattttgttattgtgggcaccggcaatgcggttaatttgaccgatgggctggatggcttggctattatgccgacagtttttgttgctgctgcatttgcgttgattgcatgggcgaccggaaatattgaatggtcaaaatatttatatattccctatattaaacatacctctgaattggttatattttgtactgcaattgtgggtgccggtttgggttttttgtggttcaatacgtatcccgcacaactttttatgggggatgttggttcattagcattgggtggagtattaggtactattgccgttttagttcgacaagaatttttattggtgattatgggcggtgtatttgtcgttgaaactttatcggttattttgcaagtaggatcttataagttacgcaatggtaaacgtattttccgaatggcaccaatccatcaccattatgagctgaaaggttggccagagccacgagtaattatccgcttttggattatttcgctgatgttagtgttactcggattaattaccttgaaattacgttaaggcaagctatgactaatcaatatcaaaacaaaaatatctgcgtagtcggattaggtaaaacaggattgtcttgcgttgatttcttgttacggcagcaagcaaatgtacatgtcattgatactcgtcaacaaccgacgggagcagaaaaattacctgaaaatgtccccttacatacaggaagcttaaaccaacaatggctacttgaagctgatctcattgtgattagccctgggctttctgttaaaacacttgaaattcagaccgcacttcaggccggtgtagaggttgtcggtgatattgaattattttgtcgttacgccaataagccaattattgctattacaggctcaaatggtaagagtaccgtgactacattggtcagtgaaatggcgaaagaggatggcttaaaagttggaatggggggaaatattggtattcctgctcttgagttattgcaacaagattatgatctctatgttttagagctatcaagttttcaactggagacgacttatagtttgaaagcgacagccgcaacgattttaaatattagtgaagatcatatggatcgttatctcgatattgaagattatcgccaagccaaattgagaatttatgaaaattgtcaacgtgcggtaataaatgccgaagatgtattaacaacaacggaagatttaaagtctccaattacttttggagaaagtcaggctgattattggctaaaaacggaaaatggcaagcaatatttaatggcaaaagagcggttaattttaccttgtgatgaaatgaaattggtaggtcgtcataattatatgaatgcgttggcggccagtgcgttggttcaggctgtcgacataagttttactgcaattcggaccgcacttcgtaaatttaccggtttagctcatcgctttcagttagcatatcagaaagatgatgtacgttggattaatgattcgaaggcaaccaatgttggaagtacagttgctgcactgaccggtttgtatgtagctaataaattacatttattgttggggggggatggtaaatccgcagatttttcggaattggcaacattaattaatcaaccccatatttattgctattgttttgggcaagatggtaaagaacttgccgcactatcagtgcaaagtcagttatttgatacgatggaacaggcaatagaagctattcgtccgaatttacagcaaggtgatatggtgcttttatcaccggcttgtgcaagtttggatcaatttaaatcctttgaacatcgaggtgatgtttttagtgatttagcgaagttggcacagggttaaagatagagacaaaatgggacaaaataacgtaaaacaacatattgatcgttggttgcgtattacaccaacaacagcattatatgatcgagcattgctatggttgtttattattctattgtgcttgggattaattagtgtatcttccgcatctattccaatcagtacaagattatttaatgaacctttttactttataaaacgtgatataggatatatttttatctcgttaattgcttttgcgtttgttgttctcataccaatgagaatgtggcaaaaatataacgttatattattttggattgctgtgattttattattgctggtgcttactggaatcggaaaagatgcaaacggtgcaaagcgttggattccgttacaactatttaattttcaaccggctgaatttgccaaattagcactaacgtgttatttggcagattatttcacacgccgttataatgatgtacgtagcaaaaaattaagtgcatttaagccattttttgtcatggctatattgggtggattattattgttacagcctgatttagggagtgcggttgttttatttgttataacttttggcttgctttttattgtcggtgcaaatttttggcagtttgtagggttgggaggaatcgcttttttcttattcctatggttagtcgcatctgcctcttatcgtttaaaacgctttacaggttttcttgagccttttaaagatcctctaggagcaggttatcaattaacaaactctttaatggcttttgggcgaggtgagttatggggcgaaggattgggaaactctgtacaaaaattggaatatttgcctgaggcacataccgattttgtcatggcgattgtcggtgaggaatttgggcttgtaggcattattgtggtggtgttcttacttgcgttactcgtttttagagtaatgaaaatagggagagagtcattattattagaagaacgctttaaagggtttttggcttttggtataggtttttggatattttttcaaggatttgtaaatctcggtatggcattaggcatgttaccgaccaaaggattaacctttccattagtgagttatggcggttcaagcttgctgattatgtcagtcagtattgcaattttgttgcggatagattacgaaaatagagttgttcgagttggaagtgctcgactaagagatgattaaaataaggaaaataccgtgtcaaaaagaaaaaaattattggttatggctggcggaaccggaggtcatgttttccctgctattgctgttgcacaatatttacaaaagcaagattgggatatttgttggttaggcactcgggaccgtatggaagcaaagttggtgccaaagcacgggattccaattgagtttattcagatttccggtttaagaggcaagggattaataactttattgaaagcaccttttgtcattttaagagcggttctacaagcgagaaaaatcataaagaaatatcaaccggatgtggtactcggcatgggaggatatgtctctggacctggtggagttgccgcaaaactttgtaacatacctgtagttgtgcatgaacaaaatgctgtattaggtttaacgaattcattgctggctaaaattgcgacacgggtattacaagcatttccaaatacatttcctaacgcagaagtcgttggtaatccggtgcgtgaggcgtttttttctgtgcctatgccacaagaacgttttaacactgcttgtgagacactcaaagttttagtggttggaggaagtcaaggggctcatatattgaatacaatattaccggaagtattagctcaattgcctaatcgtctggaaattgttcaccaagtcggatcaggttcggtggaaaacgtcaccgcactttatcatgataaagttaatcttacgcaagaatcagtacaaattaccgaatttattgatgatatagctcaggcttatgcttgggcggatatcgtcatctgccgttccggagcattgactgtctgtgaacttgcagctgttggtacaccggctatttttgtaccctttcaacataaagataaacaacaatatttaaatgcaaaatatttagctgatgttggagccgcctatattgttgaacaacatgaattggatgcggaaaaaatagctcaattattaaaaaatgtagataaagaaaaattattggaaatggcggaaaaagcaaaaaatatgtcgacgccgttatccactcaacgtgttgctgaagttataatggatactgttaaaacttagccaattaaaatgaaaagaacattttgctatgtaaatgaataaaggaatgatgaatgcaagcatttagacaacgaattagacaaactgtacctgaaatgcgtcgagtaaaacaaattcattttgttgggattggcggagccggtatgggaggaatagcggaagtgttattaaatgaaggttatcaagtaaccggttcagatattgcggaaaatgcggtaaccagtcgcttaatttctttgggagctaaaatttctttctctcatcatgcagcaaatattgagggtgctagcgttgtcgttgtttccagtgcgattaagggagataacattgaagttattacagcacatgaaaaacgtataccggttattcaacgtgcacaaatgctggcagaaattatgcgttttcgtcacggaattgctattgcgggaacgcatggtaaaacgactactacagcaatggttgcaatgatttatgcacaagccggtttagatcctacttttgttaacggtggtttggttaagtctgccggaacaaatgcgtatttaggatgcagtcgttatttaattgcagaagcagatgaaagcgatgcgtcctttttacatttgcagccaatggtgtcggtagtgaccaatattgagcctgaacatatggaaacttatcatggcgattttgaagaaatgaaacaaacttatgtgaatttcttgcgtaatttgccgttttatgggttatctgtgatgtgtgctgatgatcccgttttaatggaattatcctctcaagtgggacgccaagtggttacttacgggttcagtgatgaggcggactatcgcatagaagattatcaacaaacaggttttcaggggcattatacggttgtaacgccgaatggagagcgtattgatgtgttgttaaatgtgccgggtaaacataatgctttaaatgcgactgccgcattagccgttgctaaagaagaagggatcgaaaatgatgctattttgaccgcacttgccgagtttcaaggtgctggtcgtcgttttgatcaattagggcaatttattcgtccaaatgggaaagtgatgttagttgatgattatggtcatcaccctactgaagttaacgtaaccattcaggcagctcgccaaggttgggagaataaacgtattgtgatgattttccaacctcatcgttattctcgtacccgagatttatttgatgattttgtacaggttttatcgcaagttgatgtgttaattatgctggatgtttatgcggcgggtgaacaggctatcgccggtgctgatagtcgctctttgtgtcgttcaatccgtaatttaggtaaagtagatccgattttagtctccgatcataagcaattagctgaaattgttgatcaggttattcaagatggtgatttaattttggcacaaggtgccggtaatgtgagtaaactttctcgtgaattagcgttagcttggagtaaagaatagttattagctcttcggagttacaaaataaaaaagtaggatataaaatgactaaaccattgaaacaacaaaaaatcgccgtcttattaggggggacttcagctgaacgtgaagtatcattaaactcaggaaatgcggtcttaacagcgttacgtaatcagggttttgatgctcacccaatcgatccaaaagaatatccggttgttatgttgaaagaacagggctttgatcgagttttcaatattttacatgggcgtggcggtgaagatggtacgatacaaggattattagagcaaataggcttaccctatacgggttgtggcgtgatggcatctgctttaacaatggataaaatgcgaactaaaatgttgtggaaagcattcgggttacctgttgcagatatggaagtcgttactcgcactagtttttcgcagttaaatccgcaagtagttgtagaaaaattgggcttgcctttaatggttaaaccttctttggaaggttcaagtgtcggattgacaaaagttaacgctattgatgatctaaaaagtgcggtggaatttgcacttcaatatgatgaatccgtactgattgaagaatggctttccggtgatgaattaacggttccgatattaggtaacgaagttttaccttcgattaaaattgtaccccaaggggaattttatgattatgaagcaaaatatattgccgataatacgcagtatttttgcccctcaggattaacggaagagcgtgaacaagagcttcgtcaattagtcaaacaagcttatgatgtcgtgggttgcaggggatggagccgtattgatgtcatgctggacggcgagggtaaattccgcttagtggaagtcaatacaaatccgggaatgacaagtcatagcttatttccaaaatcagctgcaactgtcggttattctttcgagcaattggtcgtcaaaattttggagctaagtctttaaatgagaataacgcataaagtaactgaaaatttgaaagtgacaaaacggaagtcctaccgatttgtcaacattaaatttattgttatgttgttattggttgcaatactgatttttattgttagtaatcgtcagtcgattttagaaaagttagatgatagctcaattaattcatttgctattgcaggtataacaaattttactgatgacaatgatgttcgtgaagttttgtctcgaatatcggacagcggtgagttaaaaggtttttttggacaagatattgatttggttaaacagcaaattgaaatgataccttgggttaaatctgtggcagtacgtaaaatttggcccaatcgcttaagtatttgggtaacggagcatttacccattgcacgttggaatgaaacagaatttttgtcatcagagggaataatatttcaattaccaattagcaaattaaaaacacaaggattacctcatttgtcaggacctgatcataaaagtgctgaggtactggaagcttggaataaaatttatcttgatttaaagagaaaaaatttgttgttaaaaaaaattgctatcaatgagcgtggttcatggcaaattgtgttagagaacgatgttgtattaaaattaggacgtggagaatggaaagataaattggatcgttttttcacaatttatccacagattgaaatacctgaaaataaaaagttatcttatgttgatttaagatatggtgttggtgctgctatcggtgtagtagattctgactaaatttaattttaaatatgtgaagtgactaaaatggctagaattgtagaagataagatatttgtaggtttagaagtaggaacctcaaaagttgttgctgtagtaggggaattattacccgatggcgttgtcaatgtattaggtgccggaagctgtccttctaaaggtattgataaggggagcattacagatttaaatgcggtcgtaacttctattcaacgagcaattgattcaaccgaagcggttgcagatagtcagatatttagtgtgacattggctattaccggtgagcatattcaaagtttgaatgaaaatggatttgtgcctattgctgaggaagaggtgactcaagaggaagttgaagcggcgttgcatacagcgagttcagtccgtattggagatgggctggcattattacatataattccccaagaatttgcagtggataagcaagtaaatataaaagatccactaggattgcaaggtgtgcgtttaagtgctcaagcacatttaatcgcttgtcatcaagattggctaaataatctgaaaaaagcggttgaacgttgtaaattaaaagtgaacaaagttgtttattccggatatgcttcatctcaagcggtgttgactgaagatgaaaaagaattaggtgtttgcttaattgattttggtgccggtacgatggatattgtggtttataccaatggttttattcgctttagtaaggttattccttatgcgggtaatcgagtgactgacgatattgcttatgcttgtgcgacttctaggacagaggcggaaagtattaaagttgcttatggaagtgcggtcagtcctccattagatcctttagataaaaaaattgaagttgccagtatcggtgggagagcacctcgagtcatcagcaaagaacaactttcaattattacttctgctaggtatgcggaattacttggtgtagttaaatctgaattggatcaattgaaatatcaattagaaaataaacagataaaatttgaacttattgctggaattgttattactggtggcggagctcaaattgaaggattaagagaatgtgcaacgcaagtattcggttctcaagtgaggattggtgtcccacttaatattaccgggttaactgattatgtaaataaaccacaatattcaaccgtagttggtttattacatcatcataataatgattttgaggatattttatctgaaagtgatacagaaactgacggtgtcggcaaaaaattttggaatatttgtaagaaagttgtcaataaagtgcggtcagagttttgaaaatttgattttttaatctacaataggcagaatttaggttttaattttgtgctaaagtcgggaattagcatttacggagaagaaatatgattgaaccggttgattacgattacgatgatattagcggaggtgcactcatcaaagtcgttggcgttggtggcggtggcggtaatgctgttaaccatatggtggctaatatgattcaaaacgatattggcgggacgctacttggcgttgatgaattggcttatccaatgtcagatgataatcatggcaaaattattttctatgctgtgaacactgatgctcaggctttgcgtaaaagtaatgtacaaaaaacagttcaaatcggtggtgaaacaacaaaaggcttaggtgcgggagctaatcctaatgtaggacgtaaggcagccgaggacgatcaggatgctattcgtgctatgttagaaggtgcagatatggtttttattgcagccggcatgggtggcggaacaggaacaggtgcagcacctattgttgcacaaattgcaaaagagctaggtattcttacggttgctgttgtcacaaaacctttctcttttgaaggtaaaaagcgtatgcattttgccgaattaggaatcaaagaattatctaaacatgtagattccctgattattattcctaatgaaaaattattaaaagtacttggcaaaaatatcagtttaattaatgcttttgctgccgcaaatgatatattgcgtaatgcggtcactggaatatccgatatgattacttctccgggactaattaacgtggactttgctgatgtgcgtactgttatgtctgagatggggcgtgcaatgatgggttccggtgttgttcaaggcacagcagctgatggtcgtgcagaaaaagcagcacaagaggctgttgccagtccgttgttagaagatgttgatttatccggtgctagaggtgttttagttaatgttactgcgggattcgatttaactttagatgagttttcaacagtaggtgagactatccgttcatttgcatctgaagaggctaccgtggtggttggtacaacgttggttcctgaaatgtcagatgaaattagggtaactattgttgcaacaggaattggggacattgaaagacaagatgttcagattatgtcaacatctccactgaatgagcccgtaaaacctgttgaacagcagcatattcgtccagaacctagacatgatttagatacaccgattacagagagattaaaagcatttagacccgtagacccaacaagtttctctcgtgactaacagagttcatcttgttgtttagcaataaggttaaagaaagatgattaaacaaagaacattaaaacaaagtataaaagttaccggagttggcttacatagtgggaataaagtgacattaactttacgccctgcgatgccaaatacaggcgtaatatattgtcgaaccgatatgaacccgccggttacttttccggcaaatgcaaatgcggtacgtgatactatgctttgtacatgcttaatcaacgaggatggggttcggatctctacggttgagcatttgaacgctgctttagctggattaggtattgataatattattattgaggttgatgcgcctgaaattccgattatggatggaagtgcgagtccatttatttatttgttattagatgctggtattgaagaacaaaatgtagcgaagaaatttattcgtgttaagaagccaattcgtatagaagacggtgataaatgggctgaatttaaaccttatgatggcttccgtttagatttcacaattgattttgaacatcctgcaattggtaaagatgtacgtaattatgtgatggatttttctgcccaagcttttgtacaacaaattagtcgtgcaagaacttttggttttatgaaagatattgaatacttacaatcccaaggtcttgctttaggtggaagtttagataacgctatcgttttagatgattatcgaattttaaatgaagacggtttacgctttaaagatgagttggttcgccacaaaatgcttgatgcgattggtgatctttatatgtgcggttataatattatcggtgattttaaagcctacaagtccggtcatggattgaataataagcttttgagagcattacttgaaaatcaagaagcgtgggaattagtaagctttgaagataaagaagaaatcccgcaaggttatgtttctcctgcacaggtttttatctaaattagtgttgtaagataaaagctatatttccagcgaagtatagctttttttatagctatagtttttgcttttacctattacttgctggtatggaaaaatattcaattcatcgtaggattttatatgtcattagatttaaatgaaattcgtcaacaaattacacaaattgaccgcagtttattaaagctgctctcagagcgtcatcgtttagcatttgatgttgtacgcagtaaagaaattacacagaaagcattgcgtgatgttcaacgtgagcaacaattattgaaagagttggtgcaatttgcggataatgaaaattatcaattggaaccacaatatattactcaaattttccaaaaaattatcgaggactccgtattaactcagcaagtatatttacaaaagaaattgaatgagcaaagagagaagaatattcatattgcttttttaggtaaaagaggttcttactcgcatttagccgccagaaattatgcaactcgttatcaggagcaactaattgagctaagttgtgcgtcttttgatgaagtattttcctctgtgcaaaatgaggaggcaaattatggcattttaccgttggagaatacaacctcaggagcgattaatgaagtgtatgatttattacagcatacagatctttctttagtaggtgaattggcttatccaattaaacattgtgttctggtaaatgctcaagatgatttggataagattgatactttatacagtcatcctcaagtgattcagcaatgtagccaatttattcgtactttaaagcgagttcatattgaatattgtgaaagcagctcacatgcaatgcagcttgttgccagcttaaataaacctaatattgcggctttaggcaatgaagacggtgggaatttgtatggtttaaaagtactaaagtcaggcatagcaaaccaagaaaacaatattacgcgatttattgttcttgctaagcatccgatcgcagtatcaccgcaaattcatacaaagaccttattgttaatgagtactgctcagaaagtgggtgctttagttgatgctttattggtcttcaaaaaatataacatcaatatgacgaagttagagtcacgtccaatttatggtaaaccatgggaagagatgttttatttagaaattgaggctaatattaataaccctatcgctcagcaagcttttactgaactaaaagcattcagtaactacttgaaaatcttaggttgttatccaagtgaaattgtgaaacctgccgaagtctaataaaaagtgcggtctaaatcaaaaaaatcccctttattgaaaaaggggattaggcgttgatttattttttcggtgcaagcaattcaggttcttgaggtttcgctacattttcaaaagatttattttgattcgcttgaataaggctgtctgcttgttgagccaattttgttagccccattttttcgtaagcatttttcatcaatggcaacgcatcaagagtagctttcgtgtcaggatattgttgtaacatacccactacacgatttgctacagcaacatgagcattgcgttttgcatagaatttagcaatttccaattcatgacgagcgaggcttgctctaatataagccatacgtgctaaagcatccgccgcataagggctatttgggaaatgctgaactaacgtttggaagttagcaaatgcagttttgatagacgtactttcacgtgtcgcacgatctacaccaaaaaggtcttggaaccagttatcacctaatgctgaattgcttaaacctgctatataaatgacataatctaaatgcgagctttgcgggtattgttgaataaagcgatcaattgttactaaagcattagtgtagtcttgagatttatagtaagcataaattagatccaattgtacttgttcattatattggcttcccgggaagcgtttttttgccgtgtctaaataacgaattgcttggctataatctgagtcttgtagatagctgtgtcctttttcataaagagtttgtgctgttccttcttcaatagctttacctgagcttgaacacgcaccaagagcaaggcttgcaaaagcgactaaagcgagagatttcaatttatgcatgagtgaatccttatttttacaatcaataataaatgttacaataattcgttattttatagcacattgctaaataagcaaattatctgatggattttttattatgacacaagtgatattgtcagccgatattcagccccaacatatgggacaacgcttagaccaaacgttagcagaattgttcccggattattcccgttctcgtttgaaaacatggattgagggtgatttagttaaagttaatggcgaaattattaatgttgctcgtacaaaagtttacggtggtgagttagtggaaatttgtgtggaaattgaagaagaaagcaagtttgaacctgaaaatttaccactcaatattgtttatgaggatgagcatattttagttattaataaaccaaaagattttgttgtccatcccggtgcagggaatcaaagaggaactgtattaaatgcactgttgtatcattatccaaaaatagtagaagtgccaagagcgggcatagttcatcgtttggataaagatacgacgggtttaatggttgttgcaaagacaattccggcacaaacaaaattggtacaggatttacaaaaacgtaaaattatacgtgaatacgaagcagttgcttttggtgtgatgacacaaggtggaaaagtagatcaacccatgtccagacatccgacaaaacgtactcaaatggcggttcatccgttgggaaaaccggcggtaactcattatcgtataatggaacgtttccgtaattatactcgcttacgccttcgtttggaaacaggacgcactcatcaaattcgagtgcatatggcacatatttcccatcctttactaggcgatcaaacttatggaggtcgtcctcgtccaccgaaaaatgcaagtgaagaatttatgcaagtgatgcgtgattttaaacgtcaagcgttgcatgcaattatgctccgcttaactcatcccattacaggcgaaataatggaatgggaggctcctttgcctgatgactttgtaacattaatcaatgccttaaaagcagattatcaattacataaagatgaattagattattagtatgcaaataataaaagcgaatctcggtcaagtagcgaatgttcaagggctaatgacaactcggcaaggcggtgtaagtgttgcaccttatgacagcttaaacttgggtgatcatgtcggtgatgatgaaagtgcggttaaaattaaccgcactttgttagtgaaagaattaggcttaccgcaagatcctatttttcttaaccaaacgcatagtacaaaagttctgcgacttccttaccaagaaggcatggatttaaatgcagatgcagtttatagtgatcaagctaaccaagtttgtttggtgatgacggcagattgtttgccggtactttttactaatagacaaggcaatgaagttgctgctgctcatgccggttggcgaggattatgcgacggtattttagaggaaaccgttaagcaatttcgtgttcccaaagaagatattatagtttggctaggtgttgctatcggccctaagttttttcaggtcggtaaagaggttgttgagcaatttatagcaaaagatcctcaagctaaaaatgcctttacgccagatcgggaacaggaaaataaatttctgggtaatctgtatcaaatcgccaaacagcgtctaaatgctttgggaattacagaaatttacggcggagaacattgtacatatagcgataaagagcggttcttttcttatcgtcgtgatggtaagacaggtcgattggcttcattgatctggttttccaagtaaaaaagagcggttagttgtattgagtatctaaccgcttaacagggaatagttattatccttcgaagccgtcaaacaaggctgtgcttaaatatcgttctgatgcagaaggtaagataacaacaatgagtttatcggaaaattccggacgttgtgcaattcgatcggctacagcgagtgctgcaccggatgagatccctccgagaataccttcttctgccattagacgacgagccgttataatcgctgtttcactactgactttttctacttgatctactaaagataaatctaagtttttcggaatgaaccccgcaccaataccttgaattttatgtggtcccggtttggtttcttcacctgctagcgtttgagttatcactggtgattcttcaggttcaacggctacggtaataatttttttgccttgatcttgcttaatgtaacggctaattccactaattgttccgccagtaccaacaccagctaccaatacatcaattttaccttcagtgcctgaccaaatttcaggtcctgttgtttgttgatgaatggctggatttgcagggttttcaaactgttttagcattacatagtgatttggatttgaagcaacaatttcttccgctttagcaatagcccccttcataccgttgacaccttcagtcaacactaaatttacccctaaacctcgcaataagcgtttacgttcggaactcatagtctccggcatagttaacgtgattttatagccacgtgctgcagcaacataagctaaagcaatacctgtattaccactggttgcatcaataatttctttatctttggttaaaataccatctttttctgcttgccataccatattggcaccaatgcggcatttcacgctaaagctggggtttctcccttcaattttcgctataatgttgccgttattaccaaagttttttaaacgaactaatggtgtattaccaatagaataggaattatctgcataaattgtcattattttctcctaagagttgtgagtagtattttttacagtatttttatcatagctttatgaatttcaaaatagcaaaacattctattttataactaaacgctatttcacaatcgtggttttaatccgtatgaggtttgttaatgtcgttcttaccggcataacgatattgttcaacccacatagctgttgcaccacagacagcaacaggaataatcagcaaattaatgagcggaataaatgtacataaagtcaccaaagtaccaaaagttaacgttaatgtatgtttctgtccaagttccgttttcatacgttgaaaaggcactttatggttatcaaaaggatagtcgcaatattgaatagtcatcatccatacagtaaacaaaaatgctaaaattggaataatgctttgtccaataaatggaatgaaactaagtagagatagagcaataattcgaggtaagctataagtcaatttttgcaattctcgttttagcattcttggaatatcttttagaaaatctaccgcacttccttcagtcggactttctcccgttaacattttttccactttttcagcgagcaaggcattaaaaggtgcggcaataaatccggagagtgttgtaaacataaaataaaaaatgcttaacaacataagtacagctaatatgagcagaatcatacttaaccagctaagccaatcgggaataaacgtgatcatgctctcgagccaagtgctgaatcggtttataaataaccataacagccccgataaaagaagaatgttaagcaaaatcggcataacgacaaaacgacgcaaaccacgttgtctaatcaaatcccaacccataataaagtaatgaaaagctttttttatctctgttagttttaacataaattttccttaattgaaaaaacacacttatcaaacgacataataccgcagaattcaagtagggtaaaaaatctgtattttccatattaatcaacaagtaaaatatgataagctagcaaaaatttgctgttcgatgaagctaagtaggagaacaagataatggatttaaatgctattttaattattttaggtgtaatcgcattaataattttagttgcacatggcatatggtctaatcgtcgcgaaaaatcgcagtattttgaaaattcaaaaaactttactcgagaggcacgtatccgtgaaccacaagaaaatcagcaatatcaaaccgctgatcaatctcagtcggattttcaacgtaatttgcttgaaactgataatgactgtttttctagtgaatcagcacataattctcaccaacctctttatcattatagtgagcaaagtgcggtacaatctgttgatcaaattaaaattaggttgcctgacagtgagcctaactatgtaatgcaagaacagttctcaccgaagcataccgactacgcctccatgagcattgaagaaatagaaaaatcaattgatcttgatgagggaattaattcatcttctcgacatttacgccaagaactagctcaaatttcagggcaatcaatagctgatgataaggtcaatatagaagagcatatgtttactgaaagcagcatatcttttgtagaaccacagacaaacacggaatcccaacaggttgttgaaaaaacaaaatcgggtaattcttcttttatcatgctttatgtggttgcctctgaaaatcaaggttttagcggtttgcaattgactaaaacacttgatgagctaggatttatttttggtaaaaaacagatttatcatcgtcatgtggacttaagtattacaagccctgttttgtttagtgtggcaaatattgaacagcccggtacgtttgatttaacaaatattgcagatttttacacggttggaattgcattatttatgcaactgccttcttatggtaatgctacagccaatttacgaatgatgattagagcggcaaaaaccatcgctcaagatttagacggtgttgttgtaacagagcaacaagaaatttttgatgaacaggctgaaagggattatttggctcgtgtttcttgagtggcaaaattcgggaaatattgaccgcactttatgctttaaactttcaataggcttttgtttaaaaatactgaaaactatttggatgtgggaattctacgtcaaaaatgctgtatgaatttgctataatcaacgaaagacgcaaaacaagtgtgaatttcagttaaattattgccataaaatatgatttatatcaataaagtattcaatgttggttgagtttgtaggttaaaattttgtagtatatgcaccatcaagtgattgcttgatgttcataaagttcctaaataaaataatcataatatagcaaaactgctttgtgacctccctcttgggaggtttttttaattaattacaaagttggaagtttaacgtttctttgactgataaactgttcttttcctgtatgtctatggcactaagtccttactcgctaaatttctacgttcaattcgctaaatcctataatttcaagtaaaataaccgcactttttacatcatagagagaatatatgtcatcacaatttgtttatactatgcacagagtaggtaaagtagttccgccgaaacgtcatattttaaaagatatttctttaagtttctttcccggtgcaaaaatcggagtgcttggcttaaatggtgccggtaaatcaaccttattacgtattatggctggaattgataaggatattgagggagaagctcgcccacaacccggtattaaaattggttatttgccacaagaacctaagcttgaacctcaacaaaccgttcgagagaccattgaggaagctgtcgctgaggtaaaaaatgcgttagttcgcttagatgaggtttacgccttatatgcagatcctgaagcagactttgataaattagcaaccgaacaggcaaatcttgaggcgattattcaagctcatgatggacataatttagaaaatcaattagaacgcgcggcagacgctttacgtttaccggattggaatgccaagatagaacatctatcaggcggtgagcgtcgtcgtgtagcactttgccgtctattacttgaaaaaccggatatgttgttacttgatgaacccactaaccacttagatgcggaatccgtggcttggctagaacgtttcttacatgattatgaggggaccgttgtggcaatcacccatgatagatacttcttagataatgtggcaggctggattttagagcttgaccgaggagagggtattccttgggaaggcaattactcctcttggttagaacagaaagagaaacgtttagctcaagagcaagctacagagtccgcgcgtcaaaaatctattgaaaaggaattggaatgggttcggcaaaatcctaaaggtcgtcaagctaaaagcaaagctcgcatggcacgctttgaagagcttaactcaagcgaatatcaaaaacgcaacgaaactaacgaactcttcattccacccggtccacgtttgggtgataaagttattgaagtgcagaatcttaccaaatcttatggcgaccgcactttaattgataatctttctttcagtattccaaaaggggcgattgtggggattatcggagcaaatggtgctgggaaatccactttattccgtatgctttcaggacaggaacaggcagattctggctctattactttaggtgaaaccgtggtaatggcatcggttgatcaatttcgtgatgcgatggatgacaaaaaaacggtttgggaagaagtttccggtggcttggatattatgaaaatcggtaattttgaaatcccaagccgtgcttacgttggacgtttcaacttcaaaggcgttgatcaacaaaaacgtgtcggtgaattatccggtggtgagcgtgggcgtttacatttagccaaacttctacaagtgggcggaaacgtattactattggatgaaccaaccaatgacctagatgtagaaacgttacgtgcattagaaaatgcgatattggaatttccgggttgtgccatggttatatcccatgaccgttggttcttagatcgtattgctacccacattctcgattatggtgatgaaggtaaagttactttctacgaaggtaactttaccgactatgaagaatggaagaagaaaactttcggtgcagaagcaactcagccacatcgtattaagtataaacgtattgcaaaataattctttgtataaagggaaatattatgaaaaaaatcattaccgtattatcagttttagctgtatctgcttgtgtttcaacagagctatcgacacaaaataagacatataacaatttacaagatgcacgtatccgtttatatgggcaaaatcgtcgtccctcatcaatggaaattgaaattaatggcaagactgaaaaaatcaccgttggaggtggtttgggacaggcttttggttcaatgcttggagttaaagggaatgaaagcattggtatgcctgaaactgaacttagcaaagatccttctgctcattcaaaactactttcggctatcttctttaaagaattcgttataccggcaggtaaagaagtaaaagttactaacagtattcatgacgtaacgaatatgggagaatattatacctcaacacatagaataaccaccactacaacatttaaagggtgtaacggtgatgtcattacttttattgcagaagcaggaaaagattatgaagtggctcctattagctctaatagagaatgtggtgtaactgtttacgagatcaaataattttatcagaagcccattataaactgtctataaagtaaccgcactttaagtgcggttactttatgttgcgtgattatggcaggctcaatatcagcaataggatattcacttttaccggaaaaatcattgaaaattaacaatgacaacataaagctttctagatgaaatcagcacagaagagttgccccgaaggcactaaaaagattagcgaccgtatttgttgaacaagaaccttgccgagcttttatctgggaaagtcaaaaagttcgtcgtactgtgctgtttgttgctaaaagtgttggttttattggaaacctaacctggtcataaaactctgtaaaactgtttgcggatctaaatatattgaagaaaacaaccgcacttattggattaaagtgcggtaagtatttagctcaaattggacgctgtgataagacgttgcgtataagcatttttaggttgggtaaatacctgctcggttgtacccgtttcgacaacctcacctttactcataacaataacattatcgcttagtgcttttactacagataagtcatgactaataaaaatatagctcaagccatattttcgttgtagtttattgagtaattcgatgacggtaatttgtgttgaacgatcgagtgcagaagtcggttcgtccagcagaacaaatttcggttcaagaataatcgcacgggcaatagcaatgcgttgtcgctgtccgcctgaaaactcatgagggtaacgattaatcatagagggagaaagattaacttcctccaacatattcatgactttttgtcgccgctcttgtttactcatgtgcgggcaatgtacagtaagaccttctgcaataattttatggggtagtaacaatatttgcataaagtaaaagaaaaatttgggtcggaaaaagttaggtgagggcttgtggttattgggtttgttgaggttggggcgttggttttatgcaaaatagggaaatgagcaggaatggtaaaaaatgggtaaaaattggattattttttgcataaaagtgatcrgggtttagatggtttttaaaagatttttaaaacaggtttaaawctytaaaaatggyartaaaraytaggcaaggcgrtttcaggtgaaatcgcctttatttttttggggggaaatcttgtggttttggtgcgtttaggtgaaatctgacttatttttgtgagggattatgcctaaaaatcacgatagccacgcactacttgcccaataacgataaggctatttgcttcttcagcttctagctttaatgggcggtatgttgggttatcgctaattaactctaccccatcataggttaactgcacttttttcactagcattgacccatcattatttaaaacaaatattttcccatcaactaaattacgtttagagcgatccacaatgatttcttcaccatcttttaaggttggatacatactttcaccgctcaccaaaaaacattgcacagttttcagcctttaagtgctttgtttgtagccaaacaagttctacttttatcatctgtgagaactacacagtaaatttatttaactgtgtagttagtaccaattttttataaagtaaacagaatacataaaagaacaatataatcaatgtgttataaattttaggcgttttttttcggatttctttttgtgtagtctaataactctttttctgtgtattcagctaaacgcatattagcgattgaatgcttacaacacattttggctgtttcggagattaactgcttaccttgagtatcacttcttctaaaatttgccagtaactttatttcatccatattcagtaaaactggatttattgcatcagaaggcgtgattagtgaagggttaattgtggcagaataatcatccatatctatttcagttgctttatctttaatggcgttcacaagatcctcattattagcattatttggttctctaatcccagatagaatgtaattgatatccagttttaaatctggacgctcaagctctaatagtcttaaggcattttcaggaaatacacctctacgctttctttcagcaaaggcactttttgacatttttaaaagttcagccacctctttatccatcgttaatgatagttcagtttttaatcgattggcgatgtctgtgaaatttttcataaaaaacctcttgaaattcataaaaatcatatttaatatgaactcagtaaacaataatgaactttatgatttcatattaattcgtattgttcttattctagttcaaaatatgtttttagtccatagaggagtttatatgaaaaaaagaacgagagatgaagctaaaaattggttcagagaaatgaatgtaacgcaatctgaatgggggcgaagaaatggttatagctctaatgaaattagccgagtattgacgggaaaatcaaaatgcctttatggaagagaacgagaaattgctattaaactcaatatagctttagaaagttagaggttcatatgtgtgaactaaagccatactattctgctcaagagttaataggtttacagctagtaatcttaccaacgaccaaaaaagcagtaatagacaaagccaaacgcgaaaattggcaatctcgtaaacgtgttggtcgtggcggtggtgttgaatacgccctttcctctctccctcaagaggtgcaagaggaaatcagagataaatttgcgacctcggttgtggcgggcaagcctaaaaagttgccagtgttgaaatcggtcgtgttggaagacctcaccgaaaaacaacgccaagcggcagatgcaagaatgacgttagtggcttatatcttgcagttggagcaagcacaacctcgttataaagcggtgaagtttttttgccagcaggcgaaacaaaatttgttatcacctgaattaatggcattagtggctaaggcgaataacaaaaaaggtgaaagccgtgtgattggtgaacgcaccttaaatcaatgggtgttggattatgaaaaagcgagcaccccagaagaacgtttaaaagctcttgcccctatgcaacgggtggcaaaaaaggcagaagacatttcgtggttgcctgattttctagcggaataccgccaaaccaatggcattaatgtggcagaagcctatgggtattttgctcaacattggcgagagcgttttgaggatcaacccttaatgcttgagatgttgccaagtcttaatcgtgtcagaagagcgttagccaaattgcctcgccatattaaagaaattgggcgtaaaacggggtcagagcttcgggcattaaacacttatgtgaagcgggattggtcgaaattgttggtaaatgacatctgggtaggcgatggacacagtatgaaaatgaaagtggctcaccctgaacacggtagcccttttatccctgaaatcacgctgattatggacgccccttgtcgttacattgtgggttggtcggcaagtctgtcagaaaacgcccttgcggtggcagatgcgttacgcaatgggatcgaacagcacggtatccctgcgatttattactccgataacgggggcggtgagaaaaactggctacttgatggggatattacagggatgttgccccgtttaggcatcaatcaccaaacagggataccgggcaacccacaagggcgtgggattattgagcgggtacaccaaacgattttataccgcattgcacgccaatttgaaacctatcacggcagcggtgctgatagggaaacggtgagaaaggttagcactggcgtggtatcccttgaaaaagccttgcgaaaaggcactgcacttgaagatttaaccccgaaacaacgcggggctatgggtaagttacccagttggaatcagtttttagatgcggtgcaagcgggcatagattggtacaacaacgagcataaacacagtgaaatcggcaatgttacccccgcagccaaacgccgtgaattaatggcaaaaacgaatgaagaaaacttggtttacctcacccaagttgaagcacgggatctgttccgcccagcggtagagcgtacaccagagcgaggttgggtgcggttgtttaataacttttactttagtgcgaagttgttagaggtagatagagaaaaagtgcaggtggcatttgatattcacgacccaagccgtgtgattattcgcaggctagatggggtgtttgtctgttatgcagagcttgatggcaataagcgtgatgcgttcccgatgagttttgtggagaaaacgagaaaagagcgtcatcaacgccgaatgaagctaaaacaagagcaacttgatgaaattaatgcggaactcaaccccgtgcttaccattgaacacaaagaaagtgcggattggttacatcagttacgcataaataaacaaaatgaatgggaggaagacgcggaagaaattgcggttttcccaagtgaaatgaaacgtcaattattaaaaagaaaggcaggttaaacaatgaaagagcaattacaacactatatgcagacacaggggctaacgcaggggcaaattgctaaggcgattggtaaatccatcaccactgtgagccagtatttaaaaggcaattacaacgggaaaaccgatgaaattgatgatgccgttgcccgcttgttgcaacgtgaaaaagataaggtggtggaacgccgttttaacagcgaatttgtggaaacttacgcggcacagcgttgtttagatgctatctacattgcccacgcagaaagtgatattgcagtgatcacaggggcggcaggtttaggcaaaacccaagcactaaaacactacatggaacgcaaccctgaaaccatttttgtggaagttgaaccaagttacagcccgaaagtgttacttaaaaatctgtgtcagcagttgggactaaacgaaaacggactaaatcacgagctctttacccgtatcaccgaaaaacttggcgaaaaccgcttaattattgtggacgaagcggaactattaagcacgaaaagtttggaatatttacgccgtatccacgatttaaccaagtgcggtgtggtgttggcaggaatgccgagattaatcgttaatttaaaaggtaaatatggtgagttagcccagttatacagccgtgcgggcgtacattgcgatttacaaaacgccctagataaggaagacatcgccttacttgcccagcaaggcttaggtacggacgaatttaacgacctgctttacaaagtaagcaaaggcaacgcaagacgattgaacaagttaatgcgtggcgtgatccgcgtggcggaaatgcacggaaaaccgattagcgaggcactgattaaccgttatgcggaaatgttgattaattaaggaggaaatatgggctttaaaacaaaagagtttgataactggataggaaaaaatggtgacattttgatttctaaaaattcaaaagataaatggattgctgcagggggatggagcgaagaagaggacgactttactttgtacagcgtattaaagaatagaaaggcatggctgaatttttaccgtcaaacgagagtgactaaataaggattaaggagaaagaaaatggcaagagcagacattattgacacagcttatgcgttacgtcgtgagggtgtggagattgtgaaatcaaaagatgggcgttttccgagttttttaattttacgcccaagccaacgcttaatagcaaatgcaacgcagattgtggaacgcattaacgggcaacgccgtgagcggtttatcactcaagtgggaaattgtacggtgtactggttttgaggtgagcaatggcaaagtctctggatatttacgccgtctatgagggtgaggataacttaggtgacggcacagcggaacagttagcaaagcaatttaacttaagtaaaacaacgatttaccgttatgctaagttaggcgataaaggaagtaagaaaaaacggttaatcatcatcaaaattgataaagaggaaaaagaaaaatgaaaaaaattgccgtaatttgcaccgcacttttgttggcggggtgcattgaaaaagcgccacttaatgatatacagccaataaaaaggtatcaggtaagcacatacggcgaacttaaagaggtatgtattgatggtgtggtgtatctactactcataaagggtggtattaccccaaaaatcaacgccaattatgacgtttatatctgtaaccaatcaactaacccataggagaaaacaatgaaaactgtaatcgaaggcaaaacctactggaaagatgcaaaaggcaaccttaccccagaagaattagtgaaagacatcgacaaagaacgcgatgcactggtgcaagaatgggtagaaaaagccaaagccttaaacgcggaaatgagccgttttaaaggcgggatttttggcgatattcaggcgtttgtggaactttccgccgaaaaatacggcacaaaactgggtggcaataaaggcaacgtaacgctatttagctatgacggtaaatacaaaatcgtgcgagcgattagcgatcatttgcaatttgatgaacgcattcaggcggctaaggcgttaattgatgagtgccttagcgaatggtcggaaggctctcgcctagagctaaaaaccttgattgagcgagcgtttgatgtggataaagaaggcaatatcaacacagggagaattttaggcttacgccgtgtggaaatcaccgacccacgttggctaaatgcaatgcaagccattagcgaaagtgtgcaaatcgtaagcagtaaagcctatgtgcgaatttatgagcgggtgggtgatagcgatcaatatcagccgattagtttggatatggcggggatgtaaaaatgtttgaagatgttagtgatttaaaagaagcctatgatttttataaagcagttaagaaagataaagatgctattaggtgtggttgtttaagtgacgcagaagattggatatggagagagccgcatgcgttatttgcagaagacgatgagcaggaggtatagcaatgttagagaaagttgcaaaatacagtcgaattttttcgggagcagtggcgattaccatattgctgattgcagtgcctgtgttttttatccacgaagccgtagcgataaagttgatggcgtcagcgtgtaatttttttgccatttttgtcttttttgaggttttaaaccttaaaagttgggtacaacaaaatatcgcaacattgataaaaagtgcagaaattgcatcaaaagccgcttatagcttaaagcagcataaagggctaaatcttgtggtcaatggcaacacagttacacctgatagtagtgaacgggaggtataaatggaaatgttactttatatcgctgttggcgcatttttattccctttttgttttggtttaggttgtatatgcgtctataaaatgatggagaaattggtcaagttaaatatggattaaagcccttttcaacacgctttaaagcccatttaaggcgtgtttataaagtgttttaaatcaaaaaataggagcaatgacaatgaattatcacgctgaaatagacgttaaattgactttgggtattgaagctgaaaccaaagacgaggcgatatgttatatcgaccaactactggaagaaatccatgaaggctacgctattggtctgaagtatcgaattaattttgtaaatgaggaatgcgacgatgaagaataaatatcttgtcagagtgtacggaatggttgaaatcaccatggaagccgaaagtattgagcaggcaatggcacaatgtgatttgaataccttagatttaaataaattgccacatcaaatcackgarattgaygatgtrgttgaagtggaggaagtatgacaaagcaaaaacaaagcgarctymrgctmaagctggatatgatgatcggacagctkcaacargcrrtkmragcsattaayacgggyraytatattrcrgcsggggtrtatatggawatggtrcaaaaccaactgcmaaaggcragatggcargtaagggggtaaaratgaaatcttttacattaattttaacagcaacttttgattttcgcgatgatgaatttaatgatatcggttttaaatggtctagtatagacggaaaggcattattagatgcgccaagagaactggattttacaatttataaattgatgaaagattgtacttacgcattgcctattttatcccatttttttaaggagtttagtcaagagaagcaacccgtcatggcaactgcaagcgtgcagtttgaaggggaaaatgaggattggcagctagctttttctgcactagaaaaaaacgaagtaaacgaatatatccaaggattgctttttgggttgctaacacagagaaatgaacttttgcggaaggtgaagttattggaaaaggaattgtattaaaacccatttaccgcccttttaaatctcccctagcccctctttaccaaagaggggaactgaaagggcggaataatgtgttttaaccccgttttaaaaggagtttaaaaatgaaatgtaaatgccctgcgtgcggggcggtgttgtcgttagatgtgttgttgcaacacgagcaagcgagccttgcggtgatgaatgccttatcgctcaatggcgagtttgggcggttggcggtgcagtatttagctctattccgccctgaaaaatccgcactcacaatggatcgcttagcgaaactactcagtgaattggttgatgaggtgcaacgcgggcagttttgccgtaatgggcaggtttattcagcccccattgaatgttggattgatggcttaaccattgtgttaaatagtcgccaccatatcaaacgcccctcgcctcacacggctatttgtatgaggtgatgaccaaatggcaaggcagaaatagccatcataatatgatgaacggacaaagtaatccgcctgccactgccccacaattcggcagcaaaacgggcaaagctctgcaaaatttagcggagtttgccaatggctgacgaaaaatggctaaaacgaaccgtagctcaagggttgggaaaattggtggtgttacgccttgccaaccaaccgcccgaagagatgatcaaggctacggcagaagtgtgggtgcaggtgattttaagccaacgcatttatggcggctggcaagagaaagaagataaatggcgaattgaacaggcgtttatgcggttatgtgcagaatgtgagcgtttccccgccccgaaaatgctgttagaccgcttacccaaacgtaaaacccttgaactaccaccacctcaaccaaaaccattaaccccagaacaacaagcgcgcgtcagtaaaatgttaaacgaatggcgaggagtattaaatgcaaaacgatagttaccgaaaaaatctcattgctaaagtgcatattggtaaaagtcagttaaaaatggacgaagaaacctaccgcacttttttaatgaacgccgtaaataaaaccagttgcaaagcaatgagtaacaccgagcttaatcaagtgttggatttaatggcacaacgtggggcaaaagtgcggtcgaatttttggggaaatcgcccaagtccagctaaagcgaaaaagccgtaccttgccaaaatcaccgcattacttgctaagcataatcttacaccgcaatatgctgacgcgattggcaaaaaagcctttggtattgaatttattgactggcttgctgtgtggcaattaaaaaaagtgattcaaatgttgtcggtgtatgataataagaagaagttgtaaaatattttgcataagtataaattaaaggttcgttttgagccttttttaatggagcaaatatgagaaaactgataaatctcttaatatttacaataatacttattccagtatcactgcaattattatctaatcctgcttggggaaagggtcgttatctgccaaaatgcaatgaagtagatgatcttttaagccaaattttaaatcagcaaactaaagaaacaaatattgacttaacgctcaaaaacattactgctgttagagaggtaaaaaagatagaacaagataaaaatatacgtctttgctacgcaattttacaaacggcaacctacaataaactagaagcattatattcggtttctcctgatggtaatgatttttgggtgcaaatagaagaagtaaaccctattattgatgccaagacattaagtaaaacgggtgatatgttaaataatcaaatgggagaagatagattacaggcttttgaaatggcgaaaaaatttggtgatatgaaagaggcttgtctatccttgagtgtcgccaaaaatttttcttaagtgcaaaaaatgaggttaaatatatacaaaccaataaactattagaagagttctgcaaaaagtaagtataggctatctaaaatcccgccaagtgcgggatttttttcaaaaaattctccagttaagtgatcgtttgaaaaatcccgtgtgataatggcgaaaaaatcaatacgggagattaaaaatgagtcatcttgaagatgttgcagactgcttaccccctgttgtactggaaatggtggatttggtgggctttgaggtaaccgaaaaaatcattcgtcattttggcggggtatgttttttatttagtgatggtgcgatgtatttcccgaaactaaaatcgctggttggattagaacatgccaccgcactacgccagtattttaaaagtgaagaagtctatattcctcgctgtgaagtggcattaagaaccttacgtaatattcgcttggtgaatgactttttaattaaaacccaagtggagggaaaaagcgggcgtgcagcaatgttggaactttgcaccaaatatgccctttctgatcgccaagcgtgggaaattgtgcgtaatgcccaacgtaactcaccgcttgcaaccaaatcatccctattttaactgtggaagtgctttgtctattaggctaaccacacaaatctgataatcacctcaataatgtctttgattattgaggttttttatgccctttccaattacaaaaattgtggtgcattgtagtgccacgcagaacggtaaatccttacgcaatgaaaggctaaccgcagcccaacggattgatctttggcacgctaagcgaggttttttgcggaaaaatcaccaatttaacccgtacttacgccatatcggctatcaytttgtgattgataccgacggcactgtagaaacaggacgtgcagaaggagaaatcggcgcacacgttaaagggcataacgcccatagtttaggcatttgtcttgtaggtggcattagcatcacaggcaaaaactacggacgctacactgtcaaacaatggcaagccttgtatcaactcttacaaaagttagaagccaaatacccagaagcacgcatttgcgggcatcgggatttatcgcctgatttaaacggtgatggcacgattaccccaaacgaatgggtaaaagactgcccgtgctttgatgtttgggagtggctggatagcgagcaagtgattaatcaatcacacttatttaaggagtaattatgccaacgactattttaggtattatcgccgtaacaatggtaatcggttgttttttcaaggtcggggaagctatcggagcttgtatcggcgatcagattaaatatcgctatgtactttggcgagataaacgaggggaaaaatgaaactcagtgaattaattaccaacgataacggcaggcttagcaccaccgcctttatccaatttttcggagcggttttaatggcgatcattttggcgtatagcgtctatttagaccgtgcaaatgtaagcgaactgtttaccacctttgctttattttgtggcggcggtgtggccaccaaaggctttgccaatgcccttaatcgccgtaaatcttcactagcacaaggagaagaacaatgatgtggcagatgtatgcccttgcggggctaggtgcagtgtttgtggcgatttatgctcggttacattggcaaagtaaaaaactcagtgaaaagcaaaaagaaatcgaaatggtgaaagccgaagccagagccatcgcggaggaaatggaaaatgcagaaaaacgtcagcaaattgaagcagctcatcgccgtcttaacgctcacggcgttgatgaccagttgcagtcaaaaggttacttccgtgaggattagcggttgcagtgcgtttgggctgatttaccccagtcgtcaagatacattagaaaccaaacggcaggtgctgaaccataatttagcctatgagcagatttgcggggtgaaacgtggatctacaaattagcggtgagtgggtgtttaacggggtggtatccattgccgttacctttgtcgggttttggttgcgatcggtcaaggaagagctgaaagaactcaaacaagaatgcaaagacatccgcaataactatcaaactaaagagcttgccaaggtgcatagcacacacacggacaatattttggcggaaattcgggacgaattaaaagcaatgaatcataaattagacagcaaggtggataaataatgtcagccagagaacaaaagcgtttgaaccaacgcaacaccaacgaaaaactcgatgaactgttggatttaagcaaagaagcgaatcgcaaaatcgaccgtattggggagcgggtcaatgatattgatcatcgtttgtcatcgctcgaaacccaagtgggcaaagtgaccaccaaagcctttgtggctggcggtttaggtggtgcaatggttgcggtgggcattgagttaatcaaagcaaaatttgggggctaaatggctcacgatgagaaagtgcgggcattagtacgccgttattatgtgtttgaccgctttacccttgagcaatctgcacaaaaagctgacgtgtcttttggtacagcgcgccgttggaaagcgcaagccctaaataaaggggacgattgggataaggcgcgcgatgtgcatattatggcaggcggtgaagtgaatatgatttcgcaaggtttattggcgggatttattttgcagtatcgcaccacaatggacgaattacagcaaaacactgaattgagtgccaaggataaggtgatgttacttgccgcccttgcggatagctttaccaaaatgacggcagcaagtaagcggattttgccagaagtatctgaattggcggtggcaatgcgtaccgttgagttatttggtgagtatatccatcaacatcattcttccctaatggagccttttattgatgcattgaatggatttgggcaaacactcaatgaggaatttaaaaaatgaacctattgagttttctttttgtgattgcggcttgcctttctgcccgtgatggtggggcgtggggctggtgggtatttttagcattattagtgagtgattaaaatgaaaagcaaagattttttgaaagaattaagtgcttatgctgatagcctacggcaaaagttagaagcctcttttgagggctggaatgatagccctgaagccgtggttgaacgccgtaaaaaagtgtttgatacgatttcgggttatgaatattttgtcaatcattactttccgcattacacccgctcaagctcaaaatccaaattgcatcattatctatttgaacgcttgcccgccattttacagcaagagaaaggttgcctagatgccattgctgcaccccgtggtgaagctaaatctaccttggtttcgcagctttatactctttattgcttggtgacccaacagaaaaaatattgcctcattgtcatggacagtatcgaccaagcctacccaatgttggaagccattaaagtggagttggaatttaatcaacggctacgcattgattttcccgaagtggcaggacaagggcgtgtgtggcaagcagcaacgattgttacccacgctaatcaaaaggtgcaagtggcaggttcgggcaaaaaattgcgtggtttacgccacggggcatttcgtcctgatttggtggtgctggatgatattgaaaatgacgaacaagtcagaagtccagaacagcgggataaattgcataactggttaaaaaagaccgtgttaccgcttggctctgcgggggataaatttgacattgtgtatatcgggacaatcctgcattacgacagtgtactcaatcgcaccttgcacaataaagcgtggcatacggcaaaatttaaagcactcacaaaaatgcccgacaatatggcgttatgggataagtgggaagatttttacctaaacgagggcgaagcggttgccgatgccttttatcagcaaaataaagccgaaatggacgcaggagcggaaatctcttgggcagctcgtccactcttggcgttaatgaaaatccgagcacgagatggacacgccacctttgatagcgaataccaaaacgacccggttagcggtgatgatgccatttttgccaacagtatccaatattggacatcactccctgataacctgatttattttggtgcgcttgacccttcaatgggtaaggcgggagctagtcgcgacccgtccgcaattttagtgggtggctatcatcgcgaaacaggcaagctctatgtgattgaggcacagattaaaaagcgtctgcccgatttaattatcgaagatgtgattaggctcaatagccaataccaatgccaccgttggtttgtggaaacggtgcaatttcaggaatttttgcaaacagaacttgttaagcgttccgcccaacggggcaagcctgtgccagccacggcgattaaaccgaataccgataaaatgctacgtattgagagcttacaaccgcatatcgtcaatggcttaattttgttgcatcacagtcaatccaccttaatttcacagctacgtcatttcccaaaagccgaccacgatgatggtcccgatgccttagaaatgctatggaaaaatgcggtgctcaactctgcctccattgagtggacaagcctgaatgaagcagagttagataacgattggcgtgatgaagatgatgatatttatagcatttggaaaggataaacaatggcaaagaaaaaacgcaataagcacaaacaagcacaaaataaaagtgcggttaaaattgggcaagattttcaaaccaacgaagctcgtattacggagaatgggcggattatttccgaccacccaagcaataaaatcacgcctgccaagttaaaaagtatttttgaggatgctgaggcgggcaatatccaaacccagcacgaactctttatggatattgaagagcgggacggcgatattgcggcaaatatggcaacccgcaaacgggcgattttaacgctggattggcgaatcgccgaacctcgcaatgccacgaccgccgagcagggctatcaacaagaggtggacgaatatttttatcaattttccgagctggaaaacctgctgatggatttaatggatgcagtgggccacggcttttcggcgttagaaattgattggcattttattaacggaaaatggcaaccaaaaacctttatacaccgtccgcaatcgtggtttaagattgataaagacgacaatttattactcaaaacccctgataattacgaaggtgagccactacgcccattgggctgggtggtgcatacgcataaaactcgctcaattcagttagctcgccttggtttgtatcgtacacttgcgtggcattatatgtttaagcattacgccgtccacgactttgccgagtttttggagctgtatggtatgcctattcgcattggaaaatacggtgcgggggcaaccaatgaggaaaaacgtacccttttgcgtgctttggctcaaattggacataacgcggcgggcattatgcctgaaagtatggaaattgagctacataatgcggcgaatggctcaagcgttaataacccatttttgcaaatgattgagtggtgtcgtaccgagattgctcgcctgattttggggcaaacgctcacatcaggagcggacggtaaaagctcaaccaatgcacttggcaaggtgcataacgaagtacgccgtgatttgctgattgccgatgccaaacaaattgcacagaccattaccaagcaaattattttgccttatttacagctcaatgttgatccgagcattgatgaaagccgctgccctcgctttgagtttgacaccgcagaatatgaggatttagaaaaattcgccaaagccttgcctgatttagtcaatatcggcgtggctgtgcctgaaagttgggtgcgggaaaaattgggtattcccgaaccgcaagagggcgaagcgattttaaaaaccgttcaaagcgactttaaagaagagttaaatgatgatgaaaaagaagaaaaaaccgagcaaaaacgcaccgcacttactttcagccctcacactgactgtggttgcggctgccgccaaaccgccttgtccaccgaaaaccaaagcacggacgaacagcagattttagataatgtgctagatgagggcttgcaacaggtggattttaacgcccaacttgatcctatggtacaaaaagccgtggcgttgatgttgagttgcgaaagttatgaggaagcgggcgagaaactggccgaggcttacccagatttagaaagtgacgaacatcacgcttatttaagtcgtgcgttatttttaagcgaattattagggggcagcaatgcccgccgttaattttgctttggggcttgagccaaaagaagccattgcgtttttgaaaggcaaaaaagctttacttgaccatttggacgagaaaggcttgctggaaagtgccagagccaaagccacacgcattgcgaacatcaccagccttgaaatgaccaaagatatttatcaatcgctgatcatcgctcaagagcaagggcaatctttcggcgagtggaaaaaaggcatttttgaacacttcaaaaagaaaggttggattgcgggctatgacaaaggctatttattggctgatccaaaaacaggtgagttttttggcacaccaagacggcttgaaaccatttaccgcaccaatatgcaggcggcttactcggcacagcgttatcagcaaatgcgagataatgtagatagtcgcccttattggcaatatagtgcggtcaatgatgaccgcactcgcccaagccacagtgcaatgaatgggttggtgtatgcctatgatgatccattctggcataccttttatccgcccaatggctttaactgccgttgcacggtgattgcgttagcggaaagagatattaaacggcgtaacctcatcgttagccaaagcgaggggcgattggtggaatatgaacgcaaaatcaatcagcgagaaaccgagaaaaccacggcgtttaaggtgagtgaagatcgttgggtgatcaccgaccgagggtttgattacaacgtggggcgaacgagctataaacccaacttagacctttaccctgaaaaactcgctcaccaatttgccaaacgggaaatgagcggggcgggctttcaatgggattttcaccaatttgaaaaggaatttaaggcagctaaacaagccttaaagttaggcgataaaccgaatagtacgcaactgaccgccatccgtaaccaactacggcgggaatataaatttaccgcaggcgtattaaatgcggcagataaagccaagctcggtagccaaactgcgaccgtgtggctgtctgatgatacgttaattaagcagtttagtagtcgagaggggcaaaatttcggggctgaggagtatgcggtattgcctgagttgatttatgaacctgatatgcttttacctacaagagaaaagcatttccagttttttaaacaaattaaaggtcatagatatactgtggttttgaaagtattggaaaatgaggtctttgtgcaatcattcagaaaaatgagtgagaaacagtgggataaggcattgaaaggtagccactaggcagggctcgaacccactgcacacaatccccggtactctttcaaccgctcgtccgcgatcttcgagattcatcgcttttctagtggctgtgttgaatatacccttttttatttttaatgacaataggagatgcaatggaaacattacttaacgacaaaaattggcaggcttacttacccttagctttgagcctacaggaaaaagatgagattaaagccgcattgctgaaaaacatagcgcaaacccctgacagttttactgcgctatgtgaatacttaagatgcttacgcattattgaagaatatccgttaaaaacggaataagtaattatctatgctggatttgctcttggtatagccgtttagaaatagccaagattaattgagttaaatgctcggcggtttgctcaacctcttttgtatcattaggcagagtataattggggtgggtaatgagatcacgagctaactcaatagcgagtttatctgtattagtagttctttctattttcatcgttatttccttatttaaaatgggcgatattacccattcttagggtagcagaggcatattatgattgaaataaaaatcaataatgaaaaagaggtctttgcgttattggaacgcttaagccaaggtgtgcgttataacgcccctttaatgcgtaccattgcagggacaatgcaatcagcggtcgatcaaaactttcaggcaggtggtcgtcctaaatggctgggggtaaaatctcgctccaatggttcgcccttgattgatagtggggcgttacgcaatagcattcgtgccagttgggataatgatgaagcccttgttggcacaaatttagcctatgcggcaattcatcaatttggtggcaaaaccaaaccgcataagattaaacctgtaatgaaaaaagccttgagctttgggggtattgtgcgaaaatctgttaatcacccaggaagcaatattcccgcccgtccatttttgaccctaactccacaagatgaggcagatattttagaggacgtgcaagactattttaaacagataattaaataatgctatttagcccctaaatcgcacgctgtgcgattttttcttttagggggtacgatttatcattcaaaaatttttaaaataaattaaaacgatttaaaacggttttaaaatgggttgtgttttaaatcagtcagcttctttctatttttcagctatctctcttttccctctcctttctgttgtgtggaagcctattcacagttttagcacatcgcaaatcgctatgctatgtcaagattaagcaataaaggatttttttgatgaaacttgcagcctgtagttttgagttgagccaagccaaaaatgggcgtatccagttgttgccttacggtgcatttcgagccacagacggacgaccttttgacgtggaggcttggtatgtaacagacacaaacggtaacgatgtggtggcattggcaaatagccaacgcaacccactcccaattgattacgaacatcagattttgcactcacaacaaaatggcaaagaagcaccaagtgcggggtggatggattacctctattttaccccgcaaggtatttttgccgatgtgcgttggacggacaaagccgccgactatatcaaaaacggggaatatcgctatatctctgcggtgtttagttatgacacgcaaggctatgtacgcaaaatctttcacgccgccttaaccaatacacctgctttagatgggatggatgaggtgatggtggctgccagccaacaatttttaaccaaccaagaggaaacaccaacaatggataaagccttacttgcggcattgtgtgcgttatttaacacgccgaatgccaccgaagctgaaatcagccaaaaaatcaccgcacttgcacagtccaaaggagatagccaagtggcgttatcagaggtttacatcaagctcgctgaaaaagagcaatctgttgtggcattgaccgcacaaattgccaaccctgaccctgctaaatttgtgccagtggagcaagtcgctgccttaacggccgagttcacgcaatttaagcaaggcattgagcaaaaagaaaaaaacgcattaattaccaccgcactttcgcaaggcaagctcgctcctgcattaaaagactgggcagaaagtttaaaccttgcagcattaacggattatttagccaaagccccagcgattgccgcattaagtggcgaaccacaagccaaaactgacccgaacgaaaatcaagtggcagccttaagtgcggaagataagcacgttgcaaaaatgctgggcttaacggacgcggaatatcgtaaaaatttagaaacaggagcttaaccctatgagcgttgaatttaaaaaatcagaaatcttaaaaaaattagatacccaatttcgggcggaatttagcaaaggaattgcccatattcaaccacaatacccgaaaattgcgatgactgtgccgtctaacaccgcaaccaatacctacggctttatgcgtgcgttcccgaaaatgacggaatgggcaggcaagcgtacgattaaaaatatgtcagcggtgggaatgacccttgataacaaaaaatacgaaagcacggttggcgtaccacgtgaagccattgaagatgaccaagtgggcttattccgcaatatgatggctcaagcagggcaatcggcagcggaattgcctgatgagttgatctttaaattgttgcttgcgggtgaaagtacgctctgttatgacgggcaaaacttcttcgacaccgatcacccatactatcaagatgtcgatggcacgaatgcgggaacagcacaaagtaacattaccacaggttctgatagcggtgcgaaatcttggtatgtgctagataccaacaacgtgatcaaaccgtttattttccaagagcgcaccaagccagagtttgagggcaaatttgatccgtctaagtcagataccgtgtttatggaagatgtgtatttatggggcgtgcgttatcgctgtaatgcgggctttggtttttggcaactcgctcacaaggcgaaacagcttaacttaactgcggataatgtgatggcggttattaccaaaatgaccaccttaaaagccgatggcggggcgtttatcaatgtgcgaccaaccacgcttttagtgccaccaagtttagaaaaagcggcgttagatatttgtaacgctgatgtgattggcggcacaaccaacaccttaaaaggtcgcttacaggtaatggtatccccttacattatcgaataatcatttttccccgcctgcgggcggggcgttaaggagaaggattatggcaagaaaaaccaaagcccagaaagaaaaaacggaagcggaaaaagaaaacttagaagctaacgtgaaagatgacgcattaaaaaacgatgctgaaaccgaccgcaacctagaagatagcacgacagccaaggcagaagatgagacggtaaaaaacgctgacgaaactgaccgcactttagaagagggtgcaacagccgaggcgggcgatgaagcattgaaaaacaccgctgaaactaactgcactttagaagatgacaaggtggttgaaggtgggcaagtgattaacccgattgcttatgctgtcaagttgcgtgccattcacccgcacgacagctacgggcgttgtggttaccgtttttacaaagacaaagaaacggaaatcccagcgaacgacttaacgggagagcaggttttaacccttgcggaagatccgtggttagaacttgtgccagtgtgtgaggaatagcgatggcttatgcaaccgttgccgattttgtcttgcgtgtgggtgagttacaagccattgagctgaccgaccgcgatggcgtgggggaaattaatgagcaggtgttagaacttggactagcggatagctcaagccagatggacggttatttgtcagctcgttatgccctgcccttgctctccgtcccacaaaacttagtgcggttgtgttgtgatttaacccgctaccgccttgccagtatgtcgggagtggatattactgatgagattattgagcgttacaagctcagcctaaaagagctggaacagctagctaaaggagctatctcattagggttgccagagcttaatgcagacagtgaggacagcgagttttcaggggcgatattttttagcaacaataaaaacagggtatttagccgtgataacaaagattgaacaagccttaactgaccgcttgcaacgaggattaggcaaactggttaatacggtgaaaagttatggcggtgaatttgatgatgagagctttagcacagctcggctacctatgtgtttaatcacttatggtggctctcgcattgaacgaaaagccactagtgcaaagcgttatcaatccaccgatacctttgtgattatgcttgccgtgcgttctttgcggagcaatcaagccgcccgtcaaggtggcgtggataaacgcgaggtgggggttaatcagctcattagtgcggttcgccgtttgttagatagccaaaccttagggggattggtcaaaccgcttaagcctacggcagtgcgtaccatttttaacaatgccaagtttaacgcgagttcaattactgcttatgcgttggaatatgaagtggtgtatgacgatgttagcccgttagaagatgggttatatcccgaacctaccaccgatgaaaccagccctgattatgtgtttagcgtttatcagggggagcaatccgatcctgcaccgacattggaacatattaattttaatctttacaacccagatactaacgccgatcacccttttgtggtggcgatggaggaaaaatgaaagtaaaagccgcagttggcattaaagtgccaatggaaaatcaaccttaccgctatattgagcaagagccagtggaggttgaagacagtatctattatcaacgtcgcattaatgacggggatttaatcgtggtcaatgaaccgcgtaaccgaagaaatcgggaggcaaataatgactgatactaatatcgaatttgagcatattccaacaagccttagaatgccgggtgtatatagcgaatataacgctcaaaatgctgtgagtaccttaccaactaatgagcaaaatgtattgattattgctccaatggtcgggggcgatacggcttattctgcccctgtgccgatttattccgatattgatgcgaaaaatgcttttggggcaggttcttgggggcatttaatggctcgtattgccattcaaaacaacccgatgatccgtttaacggcaattggcttaaaagataatagctcaggcgttgcggcaacaggaagcttgaccttaaacggcacagcaacaggtgcgggcgtaattaaagcgatgattggcggggtggaatatgccatttcagtggcaaaatcggaaaccgccagcgacttagccacccgattaagtgcggtgatcaacgcgggtgaatattgccctgttacggcatcggtgagtacggcaaccttaactttgacagcaaaatgtaaaggggaaattggcaatgagattgaacttagcgtacaaagtactgcacaaggcatttcagcggaagccagtgcctttgcgtcgggttcgcaaaatgccgatcttgcctctgcacttgccagtgtggcaggctcgcattatcacattatcatctcgccgtttgctgatgataaaaatgccaccgcacttcgcaatcatcttgagcttgttgcaagtccaacggagaaaaagcctgcgattggggtgctgggttggcgtagcacgatggcagccggcacaacctatgcgagcaaaattaatgccaaccgtatcacttgtgcgtggtacaaaggggcgcttgaagcaaatgctttacttgcagcgggttatggtgcagtcattgccagtgaggaagaccccgcacgtccgctcaacaccttagagttgaaaggcttaacccctgttgatgccacgcaaacgccattaaaaaccgagattaatcaagccttatttaatgggctaacaccgattacggtggtaaatcatcgggtgcaaattatgcgggcgattaccacttacaccaaaaatcctgccaatgtggatgaccccgcgtggcttgatttaactaccattcgcacgatggactatgtgcgtaaagcggttgaacagcgtgttgccttgcgttttccgcgttcaaaactgtctaaacgcacaccgccaaaagtgcggtcagaaattttagatgtgttgtatcgcttggaaaaccaggaaattatcgaaaatgtggacgcacataaaggcaaattattagtggtgcgtaatggacaagacccaaaccgcttggatacgcaaattccaacggatgtggtgaatggcttgcacgtggtggcaaatcgtattgatttaattttataggagtaagtaatggctgaaaaatatgcaggctctgcggtgttagaagtggacggcgtagagattgagattgccgatctaaacgtaaccaaacaaacagggcgtaaattggtgaagacaatgaactccgaagggcgtgctagaggctttgccaaagggattgccacttgggaaatcagtttaaccgcagccctcccaattgatggttctgaaattgattgggcggaaattagtgatgccaaaatcactatctatccccttaatcaagaagataaacgtacctcttatttgggctgtttcactacgcaggtgggggaaaaatacaccgtagataatgaagctgtgattgatattcagatgaatgcacttaaagaggtgagcgaataatggacggacgtttacttttaggcttgcccgttgatggtaagcgatattttgattttaaggtgcatttgctcacattgggcgatgagtgcaatgcccttgagatgattgcgaatcttggtattgctacaggtgaggctaagccattaagccaagcagaaaaaatgctgatggatttagcctatttatgccaacaagtggaatttgttggggtggataaacaatatattacccctgaatacttgctaaagcgcctggcaacagatgattatctcctgattgctgagactattttggcattgcgaaaaaagcatatcgccgctggggagagccaacaccaagaaaacagccacgccccaactgctatgacttaaaggcggcagagcaacattatcgaagtgcggtggtttttttagcgaaattaggctttacgccccagcaggtgcgagaaatgagccatttagaggtgtcggcttgggtggaaagtctgttgcaatctcaaggggcaaaatcacaagcgaatggcataagcaaaggcgatacagtgcattacaaccttgtacgccgcaggcaacaacaagaggcgtaagcctcttttttttatgggtttaaaacaaatttaataagggtttaaaaatggcaaatctaaaaatgtctttatggcttaaagctaaagattttgcaagtggcgttgtcgataaaatgcgtagcaatgtcaataaagcgaataaagatattgaaaatcaagcggtgcgaagcgggcaaaaacagcaagaaaccgtaaagcgtacggctcaaattaccgagcaatcttatcgccaaatacagcaagctgctcgagcaaggcaaagtttgggaatgcggagtgaaaatgctatccagcgtgaaattaatcaaaccattgccgcttatcaacgtttaaaaaccagtggtgtcgcctcaagccgagaaattgcccgtgcggcggtaatagctaagcaaaaaattgcccagcttaatgcggaaatgggcaaagtgtcgacagggcaacggttggggaatgttgttggaaaaaccatggctattggcggagcggtttatggcgtagccagtacattaaagcccgcaatggataataaaaagcaatgggatcagaatgttgctcaagttgcattaaccgccttcaatgatcaagatgcggattatatcaaaacaacaggtatcgcacgcgtaaataaagcagcatatgaaacaaccaaagccgttggtgcgggaaccacggatatggcgttatccgcattagatggaatgattaaaaatggtttatcttttgaccaagccgaagcaacattgcctacagcaatgaaaatgatggttgcgggacaaacagacggtaatcaagtgggtgcacttcttcaggtcttgaaaaattatggctttaagggagaggatttacaaaaagccttagaggttactttgcaatctggttttgatggtaagtttgaggtgtcagatatgatccaacacctacctaatttgctttctatttctaaaaatgcgggctttcacggtttagaagattacaaatatttactttcaatgacacaggtggcagctaatcaagcggggtcaaatgatattgctgctaataatgttgccaactatttgaataaattaaatagtgtcgataccgcacaacggttaaaaaaagtggatatttccaataaaaaaggtttgcaaggcattgatttagaaaaatcctatcagcgtggtttagccagtgggaaaaatgcttcacaggtaatggtaagtattgctgaaacgttgcttaaaaacgatcaggaatatgtgaagttacagcaaaaactgttgcaaaccaaagatgaacagaaaaaagagcttatcaaagcccaaatggatttaaaaaaaggggcggtgcttggtaagttgttgcctgatgtacaagcaaaagcagggtttaatgcggtaacaacccagcaagaaatggataagtatcaagccaatcttgaggacggcaaaattggcaaaaatatggataaatctgtcaaggtgcttgctggaacggatctagctaaagaagagctagccaattccttaaataaatttagtcaaggcgaagtcaccggctggttaaatagtattgaacgtaaaattaatgacgaagtgatttctgcacatcaaaacggcaacgggcaaatggtgggtaatttaggcttagcaatggatgtgggaaaatcagcagtgggctatggttttggtggctgggcgttaggaaaaggattatctggcggtttggggcgagcaggcgttggtgcggcgacgggagcaggtttaggtgttgtacccgttttaaaagcggtaggtaaagtgggcgttgttggcacaatcgcaagcttaactacatcacctgaattagatagtaaatctcaacaacttcttgatttacaacataaagtacgttcaggaacagccacagaggaagaaaaacaagcgttaatgcaacaaattaaccaatctagagaagaagcaaaattacaagacgcactttataacacaggtaattcacttggtgcgtattttacccgtaaaagtgtagaaaagtcttatatggcttatctcaatagccgtttggaaaaaggtgatatttcggaagaggttcgggctcaaattgaagaacgaaatgcctattatcagaaagagcaggcaaattcatttcgttttcgtaaaggatcaccttatgttgcttcttctcattttagtgagcaagctgatcaaagtgcgactcgcattgcaggccttagctcgcctatcggtttgacaatgccaaccgcggagggaggaacacttgcaaaacttgagcccgccttgtcgaacttagccaattaccgagctgactttgagcaatttgggcaaaccttgagtgatgccttaaaacaagccattgagagccaaaattttgtgatccaaaatcaaattaaggtggatttagatggacgaattgtggctgaacaaacttcagaatatcactatcaagatttaaaacgttgggggtaaaaatgaaaggttggacaatgcctattcaacgcgccagttatcgtggtgtgcgttttgaggtgatttcggtagatgatgaattaaaccgtgccaccattgatcacgcctacccttttgttaatggggcggatattgaggatttgggtttaaaccctcttacggtacgaatgcaagcagtgttttatggcgagggctattacacggatttcaagcagtttttaagtgcgttacaaaaacaaggggcagatgtgctagtccaccctattcggggtcggttgccgaatatgctttgcacttcggcaaattttcgccacgatgcggaaatgattgattatgtggcgttagatttaacttttgtagaaagtacacctgccaagccgatttttgtttttgagttttcttttttggctaaaattgatgaacttttaacacaattggaagattttattgatgaggtattagcgttttttgctcaaatcatggaggtggttgcctttgcgatgaatgtaaaatcacgtttattaggggcttttggtgcattacaaggttgttttgaacagctttgtggtttatttgatatgggcaaaacttttttttcattgccttctacatttggtgcaatggattttaaagcaaaatcttctcataccgctaaagcaattacacatattatagagcaagggctaacccaagttgctcagcgttctgatctcacaactaaagcaaaatttgatgaaacaataagaacggtaaagcaaattcaagccattcctcaaaatttactttcaggtaaaaatatgaatttatcgcaacaacaggggataaaatcattaacaatgtcattgtcaactgaaagtattgaaccagtgcatttgttgatgcaattaacttgtacagcgacgttaattcatttggcaacggggtttattgaagacgaaacattattgccgcaagagattgactatattacaacccttataaggactcatattgtgtcaaccttgcaattattgcgtcatcaagcccaaaaagagcaagcaaattctgcactaaattcaaccgcacctaatactggggtttataccgctactcagcaaattgcggagagattacgaactttatcccatcattttacccagcttgcaatttcggcgattaatcgtaaaccaccattaacggttagggttgtaccatttaatggcacgattcaacagatcgcccatgcgttttatggagattatcgccgttccgatgaactgctacgcttaaacccacaagttaggtttccgaattttattgctcagggggagttattaaatagttatgtcaattaattatccttatgaaaatgatgtggtggttgaaattgcgggacagcagcataaccactggaaaagctatgacattgacagtgattttttaatccctgcggatgcctttcgttttgaaatcggcgtggcttcagagcatacccacttacccgatttttcggggcaagaagtaaaagtgcggatcaatggcgaggtggtgctgacgggcattgtggacaccacccagcacgggattagcaaaacgaaccgcacttttagcctaaatgggcgagataaagccagcattttagtggattgctctgccccgataaccaatgtgaaagggctaacggtgcttgaggcggtgcaaaaaattgtgaatccgttgggtatcacaaaggttgagcttaacgccgaaaataatcccactttagataaagtcgatattgaagtgggcgaaaccgcgtggcaggctgctatccgttgtgctaattctgcggggctacatttatggtttgatgcccaaggtacgctaattgtgggcggtgcggattactccacaccacctgtggcaacgctatgctgcctaaaagatggtaaacgcaataattttgagcaagcagagttgacctatgatgtatcacagcaatttagtgagatcacctttttagctcaacgccacgggcgagctggggacgataataaaaacgatttaaaatgggtgtacaaaaacgaggcgatgaccacttataagccgaaaacggtggttgtgcctgatgtggaaaatttggcagcgttgcaaaaatgggcgaaaaaatatctctcagacagcattttagaaggctttacgctaactatcattgtaccagaccataaaacccaaacggggcaattatggcaaccgggtcagcgtgttcacgtgatttgtgaagaatatgatattgatgccatctttttcttgataggacgacgttttaccctttcccgttcaggcggtacacaaaccgaattacgcttaaaacaagatggagtttggacacccgatgcttatgttggcaaagcggaaaaagcccgcaaacggaaaggtaaaaaaggtaaaaatgggccgttaatggcaacaacaggtgatggtaaatgggagatagttaggggtaaataatgcgtcgatttagtcaagcaatacaacaaaccgcacaaacgacattaaatggcgtgcgtcaggcttttcgtggcgtgctaaatttagtaaacagtgcggataatattcaaaaaacgcaagtatcagggctagctgacgagaccttgcaagatgtggagctaatgcagcattttgggtttacctccgttcccccagctggtacgcaagcggtgattattcccatcggtgggcaaacctcgcatgggattgtggttgcaaccgaaaatggggcgtttcgggtcaaaaacttgcaaggcggtgaggtggctatctacgaccaaagtggctcaaccatcgtgcttaagcaggggcggttaattgaggtggattgtgatgattttgtacttaattgcaaaacctatcaagttaatgcgacaacgggggcaaattttgatacgccaaagttagagaccacgcaagttttaaccgctcaagggaaaattaatggcaacggtggtatggcggtgcaaggtggcagcggggcaacctttaacggtgatgtgacgcaaatcggtggtaacattacgactgatggcgatgttaacgcaagcggcaagtctttggttaatcatactcacagaggggacagtggtggcaataccggctcaccacaataaatctatttacaacaataaaaagcggtgtggaactccatcaccgctttttttgtatctgttttacgtatatttgtcagtatggacagagagttaagcccgcttactggggactatacaagtaagacaatcagtacgctcgctaatgcggcgtatatcagattaaccacacctttaggctcttggtgggcagatgggcgtgtaggctctctgctccacttaattcagcgtgaaaaagacttaacccgtgttggacttatcgcccaacaatacgccgaagaagccttacagcccttgcttgatgatgggcgagcaagtcaaatccaagtaacgcaccagcaaccacataatggctggttaattttacatattgaaatcattgataatcggggtgaaacatatcgctttaaacaccctgtaaaagtcatttaacgggagtttaaaaatgtttgttgtacccaccttagatgagataagagcaagcattttacgcgatatgcaagcccttgatcctcaagccgatgtgagcgtagacagtgataattacgcccgtgcctcaagtttagcagcggtggctgaaggtatttatgcacatcaaaaatggctgattaaacagttttttccagataccgccgatacggaatttttagagaaacacacgggattgcgaggcattcgccgccgtaatgccacctatgccagcggacgaggggcaaccattacggggcaagaaaatgccgagatccctgcaggattgcaaataaaaacggaagataaccgcttttttgagaccctagaaagtgcggtcatttctagcacgggttttgtggttgtgcctgttcgctcccttgctacaggagcgggacaaaatattaaaacccaaaccaaaggcagttttatggctgccccagttggtgtgcaaagtgaagtgatactcaatgaagtcattggtgcgacggacgcagaaagtgatgcttcactgcttgagcgtttgcttgagttgatccgccgtcctcctgcaggaggcaataaatatgattatcgcaattgggcgttatccgttgatggcgtaacggcggcttatgtgtatcccttgcggagaggattaggcacggtggatattgccattacggcagacaatgatgtacccaatgaagaaaccattcgccgaacacaagcctatattgatgatgtccgtcctgttacagcgaaagaaagcaaagtggtaaagcctgatgtaacgaaaatccattttgatattcaggtcaaaatcagcggcattacgcttcaagagataacgtcagcaatacaagccgcattggctgattattttaatacgctaatccccggtgatagcttgattgtgtcgcaatgcgaggcagtggtgaataatttagtgggtgttgtggatcgcaaatttattaccccaactgcgaatcgtaccgctgacgttacccacaaaattgagtggtttagattggggaacgtgaatgtgtcggagatgcactaatggctaatgattacaaacacgcccttgctcagctctatccgcctgtttcctacaatattaacggtaaacaatttttagcccaatgtgaggttgatggaaaggtttttcaacgtttagaacagcgtgcaacggaagtgttaaatgtgattaaccctgaaacttcggggcaaatgctcgctgattgggaacggatttgtggaataaaaaccgatacccaaaagacctacactgagcgagtgaaacgggtcattttgcagcttaatgccattggtgggttgtctatcccctattttatgcaactggctcaaagcattggctatcaaattgagattaaagaattttcaccattgcaacaggatttgcctgttcccggtgacattgtgcaatttagagacgaaccgcaagaaagcctgatttttatgtggcgagtttctgttttaaatggtgatgacaatattgtgtattttcgagcggggcagtctttagcgggtgagcgactagttgagtttggcgatcccattattgaagccttttttaaagagttaaaacccgctcatacttactgttattttgcatacaaaggttaaaaaatgaaagatttactccctaaaattgatagccaagatggcgaatttcaaaatggcgacccagccagtggcacacaaggcacgcgggtaactgccgaatggttgaatagcgtgcaggctcatttgcgagatgtaggcgaagaggtgaaatatttgttattacaagcagggcttacacctatcccaagcaaaaccacacaaatttatgaagcgattatggcggttattaatgccaaccgcagaaatggcaacacaacccaaaaaggggaaatccaacttaccgacagcatcaatatggcatcaagtgtgtttggggcaagtgcgttggcagtaaaaaatgcctatgacaaagcggttgaggcggataatcacgccgaaagggcttgccatttggctgaaagcaarcaatcccctgcmacwacattagcyggctatgggattggtgattttaaggtggggacatccaccggtgatgccaatgattgcaagattgacggcaattattattttgccagcgggcaaaatttaccgagtgcgggggcgtggcatattgcggtgatgagtggcggacaaactaacgctatccgacaaattgcccgcaaagccaatgagagcaaggttcaaacccgttattttaacggcacgtcttggagcgcgtggaaagatgtaggcggtgatggcttgcccgttggctcagtgttggcatttcctgtagccgtgcaaaatccacaaggttttttgaaatgtgatggctcaacctttgggagaacaacctatcccgatttataccgcgcgttaggcaatagcaacaaactgcctgatttacgccgctctaatgtgggaatgacggcgtattttgcgacagataagattcctgakggctggattgcgtttgatgaaatcaagsaarargtaammaaagagammtaccctgagttgtataaatacctgattgaaaaatataccagtatagacaaygtyccyaaagcggaagaccgttttttgcgtaatgctcatggtgagttgamagtaggagatgtacaactcggttccttaatcggtrcrgattcgayagacggaaacggggcattttcgccttatgtgaaagctattmaaarcacttaccaagaaaccgttgaccaagtaggsttcgatccgttgctgatagargamattggaaacggaagarscgytgtyaataacgaacrttcycckgayggcggacaacctgaaaccaaaaaacaatataacgcygggctttcgtggtcggtaggarcggrcaraaatrmmgacctkaatsamccaatcmaaaataayrawastgrcaayggtcattttrtcggcgtwactcgcccgaaatcccttgttttaaaactgtgtatcaaggcgaaaarcagttttgatgaggtggtrttttggattaargcrttyggtgcggtggaaaatcaaggtgttttggacgcctctgctatcgttcaagaamtgcaggattttaaacrgcaagccgaggaaaaaatacaakmmattacmktgcagaaagaagarattatgcacgctatacaagaggagatgggraaatcagattattcccttgttaaggtttgggaggggaagaatatatatacagagggttcaataaatttaagtgaaccttgttttggctctactgtttttctgtttgcttacgctgatagagactatccaagggaattagttgtttttagttttgatgttcctgataaacatattgatttaaaaagaaaaaattcagatcaatacacattctatggtattgctcattacacaagaagcggtggtcatgatgcatctcttacacatgctaagattaacattaaccgaaaaacaggagatcaaatcaaatttgaggatttttatgcgggatataatatttacttaagagaaatctatatyaaaaaaccaaacaacaggaaagcacgatgaacatttactttcaaaaacaacaaktaagcaattatcaaatttttccaatccctcaggatrtagagaattggattgaaaaagacgttraygaaaaggaactggaaacgcatgtwttrgtggaatttaacggcgagtatcaatgggtcgagaaatccgcygacccgatgacgaaatggaacggsaarmmatgggtcgttgatgaagagaaaatgaccgcacatttarcccaagtgcgggcggaaatgcgagagaaaatcaatgcsttgcgagatgaaaaaatyaatggcggggtrtttgtggaagcggtgggcaagtggattgatacggacgctacggcggagcggaatatcttatccgtcaaagccagttatgatttattcggtgatatggarattgcgtggacttgtgcggataactckgtwttgatgatwaayaargaaaaattaatgctgatttggcargcgttaatgaaygctaaaacaggtaatcatgctaatgccttgaarcataaaaccgccatggagcaatcggacaatccggcggaatatgattattcsrrcgggtggacaaaatgttatmacgattatttagcggaacaaggcaatgagtaaagtctatttagcactgtataagggcaacggtggcagtttgtatgaccgagtcatagactggctgatccgaaaaatcactaaggggcaatatagccattgtgaaattgccattgagcaaacggcgtttttaagtggcgattattatccgtatatcacctacgattgctacagttcaagtcctcgtgatggtggtgtgcgacacaaagtgattgaccttaaagacggcaaatgggacttgattgaactgccaaacatcacggcagagcaggtcaaacgctactatacccaaacccaaggcagaggttacgattggtgggggatgttggggattgcctttggtatccagcaaaaacgctcacgctacttttgctctgagtggtgttttaacctaatcaaaaatggtgacgagggctggcggtttagtccaaatcatttagcggcgatttttagacggggagcaaaatcagattattccgcacgaagttgatattatttgggaggggcaaaatgaagtaaccgtttagagcaaaagaagaagcggcgatgtggtaggctctgacctctaccacatcagcctaagcagatagtgcctgcatagacccgagaccgctttgtctgaccagacgggcggattgtaacaaaaccgcgtaaagtgagaaagtctatgcaaaaagatttgcaagaaatacggtgcaagtgctgtaaaaagcttcttgcacgcacaaaagataatcaatatttagaaattaaatgtgtgcggtgtaaaaccttaaacacatttaaacctactcgttaaacaactcagagtgtccgaatgccttgagcgtcagaacgccataatttaaggataaattatggcaaacaagaaaatcattgtttgggcgttatttgatagcggcaatggctgctatacccaagccgcccaaccattccctaacattgaaatctatcctatcggcattgatattgagcgtaaaaatcggcattttttaccgctgaatttagcggattttggtcggttgtttggtgataatacgctgtttaatcagctagatagcctccctaaacccgatgtcattttagccagtccgccttgtgagagtttttccgttgccaactctattaagggcgggaatgtctgttggcaatggcagggaaatacacgctttgctattcgccgtcgcaaagattttgacgcggcagcggttaaaaagcgacgttatcgttatgagacctcttttttgaatcgaattaatggtgagctttgcatttataacaccattgagattattaaacggtatcagccgaaaatttatgtgattgaaaacccttatgcgagccgcctttggcactatcttgatgagattttagcctttcctcttccttatgcgaaccctacctattatgggaattatggctggccctgcaaaaaggcgactaagtttaaaagcaatattccgctaaatttgcgttatcagcattatatttcgggcaaaacgatgtttgactgtttacacagttataacgcccgttcagccattccgttgccacttatccacgatatttatcgtcgtattattgaggtgttaggaggtaacgatgcgtcattttagtcaagcaccgttgccgtttgtcgggcaaaaacggmtgtttttaaacssstttaaacaggttttaaatgacaatatycmmratgatggcrragrctggacrattrtygatgystttggygggagtggrytrytwagccacgtagcwaagcraatmaaacccmaagcamgrgtkatytayaatgattttgatggmtaygcagasagrctaaaacacataagcgatacaaatcgtttacgagctgaactgattcaaattgttggcgatattgtaccaaaaaacaagcgattagacgacaataaaaagcaagaaatcattaataaaatcaatgattttaatgggtttaaagacctcaacaccattgcaagttggttgcttttcagtgggcaacaagtcagctcatttgaggagctatttagcaagacattttggaatggaataaagctggctgattatcctagtgcagaggattatcttgatgggcttgagatagtcagcgagccatttcaacagtttctgcctaagtttgccgacaaccctaaagccttgtttgtgttagacccaccttatctttgcaccaagcaaaacagctataaaatggcaaattattttgatttagtagattttttgcaacttattggcctaacacgaccgccttatgtgttttttagctccactaagtcagagtttgtgcggtttattgcgtatatggtgcaggcgaaaaaggataactggcaagcctttgatggagctgagcggatagtccttcaaacatcgttaaactatcaggttagctatgaggataatttggtgtttaaattctaaaaattaaggggcgaacgcccctatttttcaatgcccgccttatagcctgcctcataagccgcacgcatgaggcgtttgatattccacacgcccatatcataaaaatctaaatggtcactcattcgggtctctaatgtttcaatatcccccacctcttttgcaatggtttctaatatttttgcgatggttttttcagttgtttttttcattgcttattctcctcttaaaatgtttacgattttgtcagcgatttgctgggcggcaatgtcaaagttagtctcgattgaaacgcgttggcgacaatgttcagagtgttcaaccagcgtgccttgtggcatataaagtaaataaattgttggctcattttgataactatcttgacagacttgaaagcggcgtttcccttgcacaaattccccatttttaaagccgtgatggttttcaagtctggtggttaagtgttgaataaatgctcgtgtattaaatttcatttttatgcccctgttgttttgtgttggggacatcattgctcgttggggacgaggagtaaaggggaaataagcagtagttaagctgactgactaacaatgtagctggggaggtatggaggtctaaatgataaaaaatttgaaataattttgcataatctgagactcaatagctatgcaaaataaatttaaattttatgcgaaatgttttgcgattttataatttctccaattgttaaacgtggagacagtgaattgaaaggatcttgaaaaacaatctgcatgtcttttttcaatgcttgagctttttctttcgataaagtggcgatattttttccgttaaattgtaatatcccctgataatcaagaatttgcataatagcacgtcccaacgttgatttacctgaaccggactcaccaacaataccgagggtttcaccgacttttaactcaaaagaaatatctttaacagcatggaaaacatttttcggtttaccgaacaatgtgcgttttagcacataatcaatatgaatattttgtccattgaggaggacaggtgcattttcagccaacggatgttttaaatccgtagggataggcgtcagtaattcttgtgtatagggatgatgaggttggttaaatacttgttctgtattacctcgctccacaatttcaccgttttgcatcacacaaacgtaatcactgtaacgacgaactaaacgcagatcgtgtgagatcaaaatgatcgccattcctatatctcgttgtaattcaagcattaaatcaagaatttccgcttgcgttgttacgtcaagtgcggtcgtcggctcgtccgctattaataaatccggtttattaataattgccatcgcaatcatgatacgttgtaattgaccgcccgaaaattcatgtggatagcatgtcattttcttttccgcttcgggaattttcacttttttcagcatatccaatgcgtgcttataagcctccgctttactcattttcggatggtgaatggcagtcgcttccgcaacttgttcaccaatcggcaaataagggttgagtgaagtcatgggttcttgaaaaatcatcgccatgcgatcaccacggattaatcgcaactctttttctgataaagataatatttctttgttttcaaataagatttttgagtcttcactgtaactgatgattttttgcggcaacaattgcataattgccatagaagttacagatttaccggatcctgattcgcctacaatagcgagagtttgtcctttttctacctcaaaagaaatattacgaacggcgtgtacgacttcttcatctgtttttagataaacatttaaattttttacatcaagtaatttcattctattcattcctatttatcttttggatcgagggcgtcacgcaagccgtcaccaataaagttaaagcaaaataatgtcagacaaaggaaaaaagcaggaaatgcaatcaaccaaggcgatgtttccatttgtgcagctccatcgctcagtaaggctccccaactgctcatcggttcttgtgtgcctaaacctaagaaactgagaaaagattcaaataaaatgagcgaaggtacttccaacgaggcataaacaacgacaattcccaaaacattcggaataatatgtttccaaataatttgacgacgggaaacaccacaaacaatagcagcctcaacaaattctttgttttttaaactgagtgtttgcccacgtacaattcgagcaaggtttaaccaagcaatcataccgatagcaacaaaaattaagaaaatattctggccgaaaaatgttaccaacaatataacgaaaaacataaaaggaaaagaactgagaatttctaatgtccgcatcatgacaacatctacttttcctcccacataacctgagatagcaccgtaaatagttccgatcatcacagcgataaaagcaccagcaatgccaaccatcagcgaaattcgcccacctatagcaatacgcaccaataaatcacgtccggaagcatctgtcccgagataatgcccggaaacaaaatcaggagcgatactcatcatattccaatcagtgtcatcatagctaaaaggaattaacattggtatgaaagtaataaatagcaacatgcaacaaatgacaatcaagctggcaactgctgctttattacgaaagaaacgacggcgtgcattttgccataaactgcgtccttcaatgacgctctcacaagcgttttgcatgatattttcttccgattttgagcggttttgacgattagacaacatgagatctccttatgaatagcgaattttcggatcgataaccgcatatagaatatcaactaatgcattaaaaaagatggtaagcgtccccactaatatggtgaggctaagtactagagaataatctcggtttaaagctccattgacaaacagctgccccaatcccggcaacccgaatacactttcaatgaccattgaaccggtaataattcccacaaatgccggtgctaggtaactgataacaggaagaagagccggacgcaaagcatgtttgaaaataatttttttcaatggcaatccttttgctttcgctgtacgaataaaattggaatgcaatacttcaatcatggaacctcgtgtaatccgcgcgataccggcaacgtaaccgatagtaagagaaagaacgggtaaaaccatataataaagttgaccgtcgttccaaccgccggcaggtaaccactttaaccaaatggcaaaaaataacactaaaagcggtgcaaaaacaaagctgggcatgatcacccccgtcatcgcaaaccccatcacaatataatcccagcgactgttttgtttgagagcggcaaatgtgcctgcaactaagccgataatgactgagaaaataaatgcgacaatacccaatttcagtgacacgggaaacgcagaagcgattaaattatttacgctttgatctttgtatttgaaagaaggtccgaaatcaccttgcgagagatttttcaagtaaagcaaatattgtttaaagagcggttcatttaagtgatatttcgcttcgatattcgccatgacttctggaggataagtccgttcggaagtaaaaggactacccggagccaatcgcatcagaaagaatgaaaatgtaattaaaataaacaatgttggaagtgcttccattattcgttttacaataaatttcaacatcaagaactccaaacagattaaatcagaaaaagtaaatgttatttaaaaataaatcgtcaaattcccctaacctaatgttatcaattagggaaatttgacgggataaataagtttaatgtttaataatataaagatttctcaataaaataatatcttgaggatctttaccttcatagcccttaacataaggtttcaccaaacgcgggttaacatagttatatatcggtatgataggagcatccgctgccaaaatcgcttcggctttagcataagctttcatacgatctgtcgcctcggagaattgataagactcattcaccgcttggtcgtaggccgagcttttgtaaaacgctaaattgttacttgagttggagagaaaataattgataaacgttgtagcctgattgtagtcagccgaccaaccggcacgtgcaatatcaaattgtttgttgtgacgactttcaatatacgttttccattcttgattttccagtttaacatcaactaaaccacccgtattatttttccaaattgatgccgcggcaatagcaacttttttatggttttcattggtgttatataaaatggtaaatttcaatggattcgatttactgaaaccggcttctttcaataattgaacggcttgctgattacgctctttcattgataatttagtatattcaggttgctgaattgcaccaccttccgcaatataggtcggtgtaaacacgtatgtaggtatttgcccctgtcctaataccttatctgtaatgatattacgatccaacgctaaattcagtgctttacgtacccgtaaatcattaaatggtgctttcgtattattgatctcatagaaataagtacccaatgtacgtgaagtaaacacttgatccggcatttcagcttttaattttgggaactgctccggtggcaaggcatgatctgttatctccacttctcccgcacgataacgttgcacatccgtacttggattttgaatcgctaagaatgtcgctttatcaatcacggtttctttatcattccaataaagcggattgcggacaaattcaattttttcgttgataacgtgtttcgtcaatttataagcaccgttacctacgtaattttctactttgacccaagcatcaccgaatttctctacaacatgtttaggcaaaggtaagacagagtgatgtgtggtcataccaggtaaataaggcactgaattgcttaacgttaccacaaaagtataatcgtcaacggcttttacaccgagagaatctacttttttcttcccttcaataacatcttgtgcattttcaatttgcatgtacgtcaaataagaagaataaggagaagccgttttcggatcaacaagacgttgccatgcaaagacaaaatcatgggctgtaacaggcgtgccgtcagaccattttgaatcatgacgtaatttaaatgtccattgcttaaagtccggcgtactttcccacgaagtggcaacaccaggctgaggattaccgtcagaatccaccgtaataagtccttctaaaacctgtaaaacaacctctgcttcaggtattccttctgatttatgagggtcgaaactttgaggttcagctccattattgatgacaatttcttgctttttagccaacacggtaccagccggaacattggctgcaaaagcagatattgaaaaacctaatgccacggttgtggcaacaagagtgcgggttaatattgtgtgcattgttattctccattgtgattgttgtttgctctgctattaatacatgaaaagattgcttttgtaaataattcatactagttagatagtaagctaattagagtgaattattctagagggcaatgttacatgaattaaattcttaccataataaagtgcggtcatttctctaagtaaagatcgctgagtaaatagccaccttgcggtcttttcccttcataaccttttaatttcggatttttaataaataatccggcgtaatgataaatcgcgataaagggatgatgtttgcctaattcttcttcagcttgtgcataaatttccgctcgtttgttttcatcactttcgttgtaagatgcttcaattaattgatcaaacttttcgcttttaaagccgattttattttgcgaactattggaaagaaaatatgtcaaaaacgtgcttgcttcgttgtaatccgcagaccatgctgcaaatgccaagtggtaatttttctgattttttgtatctaaaaatgttttccactccatatttttcagcgaaatatcaaccagaccgtctaaatttttcttccacatagaagtaaccgcaatagcaatattttttagtccttcgttagtgttatacagtaattcgcttttcaacggatttgctttactgtaaccggcttcacgtaacagctttttagcttcttcgtttcgttgtgcttgcgtccaattagcatattctggttgggtgattttttctcctgcatgaatatagaacggtgtgaaacggaaagtaggtgtttgtccaaagcctaatactttttctgtaataatgttgcgatcgacggctaaatctaatgctttacgtactttaatattatcaaaaggcggttttgtcatattcatttcatacataaacgtacctaatttacgagagctatagatttgcgaatcgtattgagcacgaaatttaggatcatgataaagtgattgaggaatataagctatatccaattcgccggaacgataacgagctccccctgcactttccgttaaaatataaaaagtagctttattaataacagaatgggcgttatcccaataggctggattacgttccaaagtgattttttcatttaacacccgttgtgaaattttataagcaccgtttactacaaaattttccggttttgtccaatcatcaccgtatttttcaacaacagcacgatttactggataaagagaagtatgctgcgtaagaaggacagcataaggtacgggtgcatcaagggtgagttgtagtgtattatcatctaatgcggtaactcccaaaaattccggtgatttctttccagcaataatatcatctacatttttcattttcatgaagccaaggtaacttgcataaggtgatgcggttttcggatcaacaagacgacgccaagcatagacaaaatcatgtgcggtaagagaatcaccattagaccacttaatatttgggcgtagataaaaagtaacggttttaccgtcagacgaggtatcccagcgataagcggcaccgggaataatattaccgagttcatcggttttcaccaatccttcaaataattgttcagctattaaaccttcccccgatccttctattttttgtggatcaagggtagcaacttcagcagtaatttgaatactgatttcctgtttatccgccaattttgtaccttgaggaacttgtgccgaaaatgcgactgaagaaccgacaagtagaaataagcctaaaagtgcggttctatagtttttatattttaactttgtccatatattgtgttgcataaattttatccttttaagtaagattaaaataataagattttcattggtaaaatatttatgcgatgaagtaaagtatttttacaaattttttgtaatttttaattagcaacctaattactatttttgcattttcaaaaatgtaggagtagaattccgacatcttcaataattcatcataggtggtatttatgcaattgagacgtaaatacatcgcctcgtattgataggagcagtatatgcaatttgcgattatcggattaggtaaattcggaaaatcagttgcacgagagctgtataagctgggtaatcaagttgtaggcatggatattaatgaaaaaaaagtggagcaatgtagccattttcttagtgcaagtttaatccttgatgccacggataaaacagccttgcgagaacttaacattcaagagtttgatgcagtgttggtcagtatcggtgaaagtctggaaagcaatttactctgcacacttaatttaattgatctcaaagcaaatcaaatttgggcaaaagctaaaaatgcggcacatcacgctatactttccagtttagggattcaacatatagtaagacccgaaaatgatatgggtattttagtcggtcaatctatgaattgccctagtgtaacccactgtattccgctaggctcggatctctttttaattcatttccttgttcaatttcaaactactgttaccctcggtatgctgaaaaaacgctataaagatattgttattaccgctattcaacgaggagaacaacttattagcaatccggatgatgaaactgaaatacatcgtcaagaccatttgctgatcattggctatttaaataatctccgcactttaaccggcgaattaaataaaatccaaaatgaaatttgaacatatcaacacaaagccaccctatgtattagcgggcggttttctctttatcattttaatcggcacattattattggaattaccctttgctcaccataaaagtatttcatggctacatgccttatttacttcaacatcagcggtaacggtaacggggctaagtgtcgaagatacagcaaatttcaccctattcggacaagttgttttaatgtgcttaattcaaattggcggattgggatttatgacgtttgctatttacatagcaagacgaatgggtgccagaattggcttattcggcaatgcaattgctcaagaagcactgggtgatgtgccttttaatttacttctacatactgccaaaaacgttctaaaatttgcactgacttttgaacttatcgcaatgattattcttactgttcatttttatggtgatgtttctttttttcaagcactgtatcaaagcctgttttacagtatttccgcttttaacaatgccggttttgcactgagttcagaaagtttaatgccttatgtagatgatattattgtcaatatagtcatcaccgtattgattattattggcggattgggatttgtggtacttatggatatcaaaaatcaatgccaatataaaaaattctcactaaatacgaaggtagtactttgggcaacctgtattttaaatatcgtttcctttctaatattttatattttagaacgacaaaacccgttaacatttggaccgctaagcgaaacaggtaagttgtttgccgcttggtttcaagcgataacaccaagaactgcagggtttaatactgttgatacggcaggattaactgatgccagtagtctgctgactatgttcttaatgtttattggcggaggttccttatccactgcaagcggtataaaaatcggcacattctgtattatagtkgtagcgacattcgcctatttacacaaagaatcccatgtcaatttgtttaaacataatttgcctgatgaactaatcaaaaaatcctttgctttattttttaccagccttagttgtattggtattagtagctttttgctcttggcagttgaaccgcaatttcatttccttgatgttttatttgaagttgtttcggctttaggtacagtcggactttcacgaggaattactgctgaactttcaccgttcggagagtcaattttaattatcttaatgtttatcggtcgagtaggattgctcactatgatttatctcattatgcaaccgcactccagtaaaattaaatatccaaaagaatatatacaaataggctaaaaaataaagggaataatttattcccttattttcctaaatttaatctgttttgcaccgcactttgctcaagtttaacgacaaatatacaaagtaattttcctctaagaatgaaaaaatttatgctaacaaagccaaaaactcattttcactcagaatgttaataccaagctcagtggctttagttaattttgaccccgcactttcccctgcaataacaaaatccgttttactcgaaacactgccgctaactttacagcctaattgcaacaaatattcttttgcctctgaacgccccattttcgtcaacgtaccggttaatacgacggtttttcctttcaaaggattgtcccgcacctctttaacttcaacgtcgtcccaatgaatgccttgtgcaattaaatcttttaccacagcaacattatgaggctcagaccagaatgaacgaatacgtttagccactacttcaccaacatcttgtaccttttgcaattgctcaaacgttgcattttcaaaagcctctagtgtcttaaaatgagttgctaaatttaatgcagtagtttccccaacttcacggatgccaagtgcaaaaataaaacgagccaatgtggtttttttcgctttagctaaacttgctaaggcattttctgccgatttcgcccccatacgctccaaacgcattaaagtaacctgatctaatttaaataagtcagccggtgtatgtactaactccctttcaaccaactgttcaattaattttgcaccaatgccgtcaatatccatcgctttgcgtgaaacaaaatgtttaagtgcctctttgcgttgagcagcacaaattaagcctcccgtacaacgagcaactgcctctccctcaattttgctaataacggaatcacacacaggacaatttgttggaaaaataatagattttgcattttccggacgacgttcatgtaacacgccgataatttgcggaatcacatctccggcacgacgcacaatcacggtatcaccaatcgcaatatccaaacgtgctatttcatcaccattatgtaaagtcgcattactcacagtgactcctgcgacaaaaacaggttctaattttgctaccggtgtaatggcaccggttcgcccaacctgaaactccacattattcaaaattgtcagctcttcttgtgccggaaatttataagcaattgcccagcgaggtgctttagaaataaaaccaagttgttgttgcaagtcaatatcattaatttttaataccgtgccatcaatgtcataacctaaggaactgcgtttttgcttaatagtgcggtagaaatccaacactttttcaatcccatgacataattgaatttcattatttaccggtatgccaatagattttagccattgtaaacgagcaaaatgtgtatccggtaattccactccttctgcaataccaataccataagcgtttaacatcaaaggacgttgaccggtaattttgggatcaagttgacgcaaagaacctgcagccgcattacgtggattagcaaatgttttttctcctttcgctaaagctgttttgttcagtttttcaaaacctgcttgcgacataaaaacttccccacgcacctccaaacgagtcggtggattatccgttaataattgcaatggaatattacgaatagtacgaatatttgccgtaatatcttcaccggtcgtcccatcgccccgagttgcagcctgtaccagctgaccgtttatatacaaaatactgactgccaaaccgtctaatttaggttcgcaacaaaatgttaaagaatgatgaacatgtatcaaacgatcttgaatacgtttgacaaaagcaaagaaatcttcatcagaaaaagcattatctaaggatagcattggaatatcatgtttaacttgagcaaaattacttaacggtttcgcccctactctctgtgttggcgaattttcactggcatattcaggatattgttgttccaacgcttttaattgatgaaataagcgatcgtattcactatccggaatttgcggattgtctaacacatgatactgatattcatgatggcgtaatagttgtcgtaattcttcaatttgttgcttgatcataaaaattccttgcttcaagaccgcactttaaatagtggctcattatacacaatcatactattttacgtaaaaaattgcccctgaaaatccagaggcaataaatcaatagaaaagtgcggtctatttttacaaaataatactaccgatcaacgccagagcaaaaccgactaaaccgattaatgtttccatcacagtccaagtttttaacgtggttttggtatccatttccaagaaacgacttaccaaccaaaagccactatcatttacatgagaaagtacggttgcacctgaagcgatagcaatcacgataaaacataaatcaaattgacttaagcctgtggctgatgacaccattggtgcgatgagagcagaagttgtggtcagagcaacagttgcagaaccttgagctatacgaagtgcggtagaaattaagaatgccgcaacgataattggcatacccgtatccgaaaacatttttgctaatacatcaccgataccgcttgcacgtaatacaccgccgaacataccgcctgcaccggttaccaatacgattgcacaaatcggacctaaggcgttatcgcagattttttcgatttgttcaaaactgcgttgttctttgagtaaaatgatagtcattaataggctaattaataaggcaataggtgttttgccgattaagcgtaaactttgtacccataatgtagaaccatcaattacttttgctactgctaaagtgtttaggaccgtgtctaacataattaaacaaagcggcaacagcaaaataaataatacttttttgaaacttgggggattttgaaccgcagtttcgttaattggagctgcatttaagaaagttttcggtagcggtaaatcgaattttttacctaagtaaagcccatataaataagtagcaaaataccaagtcggtacagctaaaatgaagccgacaatggtgagcaaaccgatatttgcacctaaaatatcaccggaagcgaccggaccgggatgcggaggaagaaatgcgtgggtgacagcaaatgcaccggcagcagggaacgcatagcggaataatgaaccaccgaattgttttgcaacactgaaaataatcggcaacattaccactaaacctgcatcaaagaaaatggggaacccgaataggaatgaggcgacacctaaagcgaaaggtgcttttttctcgccgaatttattgattaaggtatcggcaagtacttttgcaccaccggtaatttccaataatcgaccgatcattgcacctaagccgactaataaagctactgaggcaagggtattaccgaaaccacctaataaggtcggcaggattttatctactgacataccggtagcaagtgcggttaataaactcactaaaactaaggcaacaaaagcatgaaccttaaatttaataatgagaagaagaagtaatgctatggaagcaatcaaaataaagatcaacataaaatttccctattaataaaattaaacagcagcaagcataccaccatcaacgaataacaaatgcccattaacaaaatcagatgctttagatgaaagaaaaacagtcgcaccgattagttcttcaggatttccccaacgggctgctggagtacgtttgcacaaccagtcggaaaattctttgttttctactaacggacgggttaattcagttttgaaataaccgggagcaataccattgacttgaatattatgacgagccaattctacgcacattcctcttgttagcattttcaccgcacctttagatgccgcataaggtgtaatagtgtctcgccctaattcactttgcattgaaccaatattgatgatttttcctgcttgccgtttcaccatatagcgagccactgtttgggaaacaataaatacagatttttggttgacattaatgacatcatcataatctttttccggaaaatcgcagaatgggtggcgacgttgaataccggcattattaattaatacatcaattgctccaatatgttgttcgatatgagcaatggcctgatgaacggcttgagtatttgtcacatcaaaagcaacagcgtgagccttatggtctttagcagttaattcatcagcaaccaattgacatttttcttgattagtaccatttataataacttcagcaccttgttcagcaacaccctctgccaataaacgaccgatgccacgagcagatcctgtaattaaaattcgtttattttgtaaagaaaataaatcacacatcttcttatccttatgcaaagttaagttggatttttgaaatttcatttttattgccagcacgttgaagagcggtttctaattgttcaaatggataaatttcagaaagtaagggaagcggattgattttacctaaacttaaccacttcacggcggtattaaattcctctacaaaacggaaagaacctttccagttaatttcttttgaaatgagaggcatcatattaaattgtggaattgagcctcccatcccaatttgtacgatagtacctttcgcttttgtgacagctaaacaacgttcaatggaggaaatatgacctgaagcctcaaatgaaacatcaaattcgcctttgttttgtaaatattcggaaaaatttccttcagtggcatgtaatacttttgtagcacccatttctaatgctaaatctaaacaacgctgactaatatctgaacagatgatttctgctgcacccaatgcttttactgccgcaacagctaaacaaccgataggaccgacaccggaaataaacacttttttcccctgcaaatcaccgccttgttttgctgcgtgaatagttactgctaaaggctcagcaaataccataacctcatcggaaacttcttgcgaataaggaatacattggttgttatctacaattttatattgagtaaaaccaccatcaacgtgcggattgtacattgcactaccaaaaaaacgcattgtttcacattgattgctatagccacttaaacaatatgcacaacttaagcaaggtttgcttggattaattgcaaccttttgtccttcaaataaattgggagcgttggtctttacaattttaccaattatttcatgacctaaaatcatggggtgtttgattgcaaaattacccactttgccatgttcgtaataatgtaaatctgaaccgcagatactgccacgagtaatttgaattaaggtttgatcttggctttgttcatcaaattcaatttcttgagaaatgacatcaacagattttgctcctttaactacgcaagataacgtgtttattttcataaaatatcctccaatatttctgttactggtaacatatttatttttctagattgggtaaagtttgtgtgtttgattttgtgatttacgtcacattttttctttatttttaatgattttttaaaaaagtgcggttataaaaataaaaatttaaaacaataaatatagatttaagtgttattggtaactttttaaaattttttcaggtacactaagctcaatagcgtatttattagaggaacaaaaaatgtcaaaaggaaaaagtattattttaatgggggtatctggtacaggtaaaacatcagtaggaactgaagtagcgtaccgcctaggattgaaattaattgatggggatgatttacacccaagagccaacattatcaaaatgagacagggacaaccgctcaatgatgaagatcgtatgccttggttggagcgtattcgtgatgcggcatttagtttggagcaaaaaagtgaaaagggcattattatttgttcagcactgaaaaaacaatatcgagatcaaattcgtgatggaaaccgaaacattaaatttatttatctatccggcagttttgaattagtgctttctcgtctgcaaaaacggcaagggcattatatgaaaactgaaatgttgcgaagtcagtttgctacgttggaagttccccaagctgatgaaactgatatttatcacattgatattgacgcaacttttgaggaagtagtgcagcgttgtgttgaagctatcaagcctcttttagattgatgacaagaaatgcttgggcgtagaggcgttatctaagacgtagattacagacaatatttttgccataaaagatagtttttgagctaatgctacgaaaaaatactcaaaccccaccgcactttgcaagtacagtggggttataaatagaaaaagcgtagtcgatttttaccagtatgcattgttattcctatgttttgttttaaaaataaaattctgcgtggtgtattattgacaaggcgttgcacaaaacaattccagcgaaattcccacctttgcagtaaaaatttaattctcttggtgttattcttgtacgatctattctctctatatttgcatttttcctaaagcaaaactcgatctatctcacaaaaatattaacaaataatttacaattcaaaccgagcatgctaaaaagcaatcgtttgcaataaaaatattgcatacattgcatacaatacaacatcaatgacatcacacaggagcaactctatgaaaaaaatgaaagtcgtattgaccagtgcaacagttctacttgctacattgcttgccgcttgtggtgataataacaaagcgtcgaaagatgttactgcgagcaacgttgcggcaaacagcagcagtgctgaaagtgcggtaccagccacagtgcaaagcaaatttgtgaccattgctactggcggtgcttccggtccttacaatattattgcgacgacactgacaggtatttatagtaaaaatctaaaaactaattccaaaacacaaactaccggtgcatcggtagaaaatttaaacttgatggcacagaaaaaagtggaaatggcgtttgtgatgagtgatgcgttaaatgatgcgttaaatggtaccggcagtttcaaaaataaaattgagaatgtggaacaaatagcagcactttatcctaactatgtacaaattgtcacctctaaacgttccggcattaaaaccattaccgatttaaaagggaaacgggtagcgaccggcgatcaaaattccggagtcgaagtcaatgcacgtaacttacttgccggttttggcatttcctatgcggatattaaggttgattatctcggttatgctgcagcggcagatgctctaaaagcgggaaccattgatgcggcgttcttaaccagtggcttgccaaattctgctttaatggaattgcaacaaagttttgatctgcaattggtctctatcccggctgacggaattaaaaaattagctgcagataaaccgtattttaatgcgatggatattccagcgaacacctatggcaatcctgaaccgattccgacagcggcaattaaaaatgccttggtgatccgtaaagagctcagcgaagcagatgggtatttattaaccaaaaccttctttgaaagtttgccacaattgcaaaccgcacaccaagcggcgaaaggcattaacgtgaaagaagcacaggaaggtgcagttgcaccattacatccgggtgcaaaaaaatattatgacgaagttaatgcgaaataattcgttattaagttggtaagcatgaagataatgcctcgtaacggttggtttgtgctggtgccactcgctgttattgggctttatcctgttcattttatatcagttaccacaaaacaaggcgaatgcatcattggtgatgatcattttgcactacgttggcgtcactccgtcgagcatcaattgtggtatgaacattatcaacgacaaggtgataacctccacctttatcaaacatggttacaaacatttggtgctggaacaccttctcaaggtgaagttgtcacccatgtgccagtgggctatgtcggttttaaacaagatgttgttttacccgaaataaattggattgtttcgcatcgtatggaagggactattttgcttgatgataaacaatttcccgtttatcaaacacttcctaattattctgcggtaacaatcaaaccggctaaatctgtaattgcaacgttgtggttaaggaaatcatgttatgactgattctgtaaaaattgacaccacacttggtgccaaagaacaagagattttggaaaaatatgaccgtgaatcggtcactcgtcaatccagtagccaatttaataaagggttaattacgctggtttcggttttatattccctttttcatttatacaccaccttttaccccctaccgacgttaatccagcgtgcagtacacgtgggcgttggagcgatattaatcctattaatttatccggcatcgaaaaaacgtcgccaaggttctgttgcatggtatgactggttatgggttattgccggtacgagcggtatgctgtatctcatcaaccaatacaatgacattatgaccgtccgaggtggtattccaaatagcacagatattgtgatggcaatcatcactgtactagtggtgcttgaggtaacgcgtcgcgttaccggttggattttggtgattttttccttgctcttcttaatctatccattcatcagctcaatggattttatgccggacagcctcctcactcgcccttatgatgttggtgatatttttggtcagctttatttaaaaaccgaggggttatattcctctgctgtgggggcttccgtttcctttattttcttatttattttatttggggctttcctaagtaaatcgggaatggggcaattatttaatgatttagccttagcgatcgctggtgataaacaagggggagcggcgaaagtagcggtaatttccagtggctttatgggcagtattaacggggcagcggttgccaacgtggtgagtactggagcgtttactattccattaatgaaaaaaatcggttatcacaaaaactttgccggtgcggtagaagccagtgcatccgttggtgggcaaattctcccgccgatcatgggagcaagtgcattcattatggcggaaacgacaggcgtaagctacggaactattgcacttgcagccttacttcctgccttactttactatctcggcgtcattgcacaagtccactttcgtgctggtaaacaaaacctaaaaggcgtccctaaagatcaattgccaagggtaaaagcagtgatgaaagcacgtggtcatatgctattgccgatcttagcccttatcatctttttggcacaatccgtaccagtaggatatgctgcctcttatactattgtgcttaccattttagtcagtcaattgcgtcaagaaacccgtatgggcattaaagatgtaattgaggcattggctgacggggcaaaacagtcactttccgttatgtcagcttgtgcgacggtaggaattgtgattggcgtgatgaaccttaccagttttggtacggtgattacctcttctatcgtcacattaggtgcaggatcgctctttttaaccttatttttaacgatgattgcctccatgatccttggcatgggactaccttctattccagcatatatcattaccgccaccatggcagctccggcattggcaacctttgatgtcccggtattagtggcacatatgttcgtcttttattttggtattttcgctaatattacaccaccggtcgctcttgctgcttttgcaggtgcgggaattgcacaaggtgacccaatgaaaaccggctggcaatccttgcgtctagccctagcgggttttattgtaccgttcatattcgtttataatccgaatatgctgatgattgatgttaccaatgctgcggttattgccaaaactttccctctaccaagtgcattcgaaattattaatgttatcgtatcctctgttattggcgttttgggattatctgctgcggtagaggggtatctgaaaaatactataccaatatggcaacgtattattttagcaatcggttcgcttatgttgattattccggaatggatcacggatattatcggcattgctgttgttgtagtcatagcactacttaatgttcgccaatgtgactaacaattgttctgtgcatacgataaatgacataactaaatgtctaattaacttttttagatttgaaccaatcattaccccttgattttgcatagcttcacaaccggttgtggcggtttgggtgttagaatgtaatgaaaaaggttatttcccttaacacccaaaatactcaaaccccaccgcactttgcaagtacagtggggttttttgttgtgtttcagcaagtttgacaaattaccactgataacctatcgacacggcaccggatactttgccttgggaattgctattaccttgcagtttcagcataaccttaccgttatcgctgatgcgagaataaccaatcgccaacgcactttcgccatcatgtcctgccgccgcaatcgcaaccatggacttgcccggcatagagactgatgccaatgctgctgccgcattcgctccggcaataccggcacgcaatcggcgatcggcatgatgtatttgtgtacgtaacgcattattttgactgtccacatagtttttattgactgcaacaaatccacttgcatcaggtttgacatccggaattaaaatttccccacggttaccattgatgacgatattaccgttattgcctgataccatcaaccctgcatgggttgccatcaatgacggttcaccggctttgccttgtagctgaatgccatcgagggtgtaacttgctgattgaccggcatgatttcctttgcccgcaatacgggtaccytgtgcmkttacwammgyttcgctgtctggactgctcgcttkyaaaccgttgctgttyarcrymgattttytrccrttsayttcacgwgtytcraamgaagtcatgttcttcaactggtcagacaatttcacttctaagccattgccatctgtttccactttgatattgccggcggcggtgctgtcgctgttaaatgtatcaccttcgcctgtgatggatagtgtttcgctgagttgtttacgcacttcaacaccatcattgcccttgaacttcatgcccgatttcgctaccgcttgcacgtcagcaatggtggctacgttggttaaatccgcttggctatcaggtttcactaagtcagcaactttttcataacccttgtagttggcttcatagtcagcattggcttttgttaattctgtctgagctttggttaaagcagtttttgctttccctagctcttctttagctttttcaagctgtttcttgttttcctccaattgagtttgaagtttctttttatcctcaccctcaggcatggcactcatcgccatttctaaaccgctcacggctaaagttaaatcggttactttttgggctgtagttgaaagttctttcgcttgatcgcctattgctttcactttttcctcaacagctttggtgagtgcagtcgctttctcttgagcctcttttgctttarcmggatcagtttcaggrkcwgsyagtccyaaaccrctcgccacgttattcatcccgacaggtgcggtagtcggctcggcacgaataatcaccttgtccgattctgctgtaacttcttgtccatctttagaggtgtattttttactttttgcatcatacttcgccccttctaaatctttaggatcatagaacttaccatctcgtcctttaataactttggtatagctgtttccttcttttatatagaagtcaaacggacgattgctgtccaaatctgacactttttcatccacatagtttttattcgccgcacttgaaccgtcagccgtggcatctaggtctttcaagcccgtgattacgccagtgcccgatttaccgtcagtgcctttagcaaacgccagcgtagctcccttgccatcttgaccgttttcaccctctgccactttcaagctcacgatttcctgaccagccttatccttaatagcaacctcgccggctttcacctcggtggtgtgcttgccattgcttaaaacattcgcttctgctgtctgatcattgaccagaacctgatcatcgctgaccacagacattgtcacgccctcagccgttgtcacaaccgctttttccttatcgggatctgtattatccgtgatgatttgcgatgtcgccgtttgtgtatgagcgttacctgcctgatctttcaasrcratttcattgccggtaatgttagycgtgttaccgytwtcgccgttaaactcggcagatttcaarcctktyaagtcctcagtcgtaccaatcgtcaccaccgcagtggtgttcgatgttgtgcttggtgtactgcttgctgttccggctgtcgtcgtacttggagtagctcctgacgaagctgtactgcttgtaccatttccgccatttgtacctgcaccatttgacgaagttgtgcttgaagcgaccgtactatctgcccctacactgccatttgatacagtgtttgtcggtgcggttgtcggagttgtactgcttccgacagttgcacctgtaccttgtgcagccatatttgacgagccggacgtaccagctgaagtcgcaccatttccacctccaacggtacctgcaccacttgcgagtgcagaaccaaccgcacttggttgtgtagtaccattttgagctaactctactttaatattcaaaccggcattaaacttcaacgtatcgttgcgaccaatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaccatatgtttgcgcttgtgataaagtcactttgctaaatgtcggtgcgtctttaaagccgatttcgattttggcattgcccttatcgttggtgtattgcgtgattaagttgctaccgctgtaaccatcggttgatgttggagctaccgcacctgtccctgtcggcgtacctaaacgaacaatgttaatagttgagccgaggtagtgggtgttgktatttgtacccgttggaatatcaccgccgaatttcaagccctcgtttaacttcgctcttgcwtygtcaatagcayctttcaatgtrgttgggttcttctctttgaatgagccgtccacmttrgacagatattcaaagattrgakcaktaaatttcgttttatccttatyaacaccaayaccyaayttaccsgctaaatcagmmagttgtttacctgtaacagcttcttttgaactctcagcaatttcaccctctgaaatctcttttaattttgcrtcattaaaattaatttctttcttagttttgtctaaagtgattttcgcacctttgtcatctgtaccaccgctaatrctmtytayatctttaagattattcgccarrttatgttgaattgaaccattykyakctacwrykacttctatgttstcatttttacctttmttraaatcyaagccktccgttagtttkacggtttgcttatttgtgctattmgmtttatakgtyawttttaattcatcaacatagtttttattcaccgcatcrtatttatcagttggatctgctacgaaaactatttttcttctgtttactgcattccctaccgatacagcattggatacgcctattgatctgtctcctaatactatcgcattttttatagtatcatctgtttctatgtgagaacctaataatatgttttcatttccatctactttgttgcccagtcctatagaaatatttttatatccttttatctcattatttgaacctattacatagcttgatgttgaatttaaacctattttattttcatcacctaayacaaamgagaarttacctttracatcattttctttacctacagcgacagaacttgttccyaatacrgttgaaccctgaccgatagagattgcaccgctattagaygcytcmgarttatarccyawggcaatrgaaccctcatttcttgacacggcattatgaccgatagaaatagarccytcgcctatcgcttgtgtttttgcggaatcagaaagtttaacggatttytccccwgtgccttttaggtagtcgactarggctttggcttgtactaattcgcttgtgccttctgtttcmtcttyytcaagakyratttymkcaataccgacrttttcwccaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttttatccctattaatatatttttactcgttttttcatactgtgttctaatattatcacttgaaaatttatctgttttatttatttttttatcttcaactgttatattcccagcttttattatcaagctatctcctaaatagtgtgttcctttttcttcagcactatctccagcaccaaatacaaaccctttatttattttatctatatttgcgttaatagcttgtctaaacgtttttgctgtagctggtgttgaagcattaatagttcctcctattaattgtttaaattttgattsyttaaatcctttagttgyatctacttctgctcctaatacagttgctcctaaatkkccaaatacatctattacactatataactgacttccattwatkgcatctgttgaagtagcacttatygttcctggwgctacatgtttaataagacgttcttttccastatctcctatacttaaaactgwtttatyagttccatgtccactaaaactagtaaatttaatattacttgtatctgttgtatatgttgagacagtattttctttagtagtcgcttttgacccttgccccaaggcaatggagttgccggcggcggtttttactgttgcaccttgcccaatcgctactgcaccgacggcacttgcttcggctttagcactatgaccaataatcaccgcactttttgcacccgtttcagcttttgattttgccccaataagcacactttcttttgcagtttcagctgtcgctccattaccaatcagaattaaatctgtattcgcattctttgttcctttagtctcctcatctgtcgtatctaatgcttgaatattgttccctaacgccacaatatccgtaccgtttttgattttatttttattaccgatagacgctgtccaagcggcgttttctatttttgttccatcttctccgtttttacctttcacaaaaaccgcacctattgctatagaacttttagattctattaattctgttccactacctattacaaccacagcaccatttatgtttttaaagttttgcgtaactttattattagaccctagtacaaacgaactatgtacatctacacttacattattacctatyacaacygcattttswgctgtggctttcgtacccacaccaatagctattgcaccttctttcgttgctccatcgttattgtaattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccatcactaaatttatacccttgatttatagccttgattgtttcgtccaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacacaccgcacttcggctgacgccccgacgctccctcaacacggctcgccacttggcggttattcgctaattcagacacaactttcgtttgacccgttgttacatcgtatttggttttgaagattttgttcatattctttactcgctttaaaaattatctgttaattacttattaaatggttattgnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccttgctttttaagacaaagcagaaaaaggcgaataatactttcgccaaaaggttgaggttgaaataggtgatttttaagatattgtttgaacatgtccaacctctcaaaattaacttgaaaggttgattttaggcaatatactaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtcattttttccgttctatttttttgttaagtaaaagtaaaatttgtcgtattttatcttgtatttatttgtaagaaaagcgtaaattaattattttaatgtcggggcggattatatccgctctttaatgttttgtttaatgtgtttggttttctgttcgggttttgacttgcacctcaaataaaattcggagaaaatatcggcttttagtcagtataacaaacgatcatgtcatattctcaacaagtaaataaacgtcgcacttttgcgattgtttctcaccccgatgcggggaaaacaacgattacggaaaaagttttactctatggaaacgctattcagaaagccggttcggtaaaaggcaaaggttctcaggcacatgctaaatccgactggatggaaatggaaaaacagcggggaatttctattactacgtcggtgatgcaatttccttatcatgactgcttggtcaacttgcttgatacaccggggcatgaggatttttcggaagatacttaccgcactttaactgcagttgacagttgcttgatggtgattgacagtgcaaaaggggttgaagaacgtacgattaaattaatggaagtcacccgtttgcgggacacgccgattttaacgtttatgaataagttggatcgtgatattcgagatccgatggaattgcttgatgaagtggaaagtgtgctgaaaatccgttgtgcccctattacttggcctattggttgcggtaaattgttcaaaggtgtttatcatttgtataaagacgaaacttatttatatcaaagcggtcaaggacatactattcaggatgtgcgtattattaaagggttaaataatgccgacttggatagggcagtgggcgaagatcttgctcggcaattacgtgatgaattggaattggtcaagggggcgtcgaatgaatttgatcacgatttatttattcgtggggaattaacgcctgtttttttcgggacggctttaggcaatttcggtgtggatcattttcttgatggcttgacacaatgggcacccgctccgcaagctcgtcaggcggattgtcgtttagtcgagagtgcggaagaaaaattaacagggtttgtgtttaaaattcaagctaatatggatccgaaacatcgtgatcgggtcgcttttatgcgaattgtttcgggtaaatatgaaaaaggtatgaaactgaaacaggtgcgtttggggaaagaggttgtgctttccgatgcactgacttttatggcgggtgatcgttctcatgcggaagaagcctatgccggcgatattatcggcttacataatcatggcactattcaaattggtgatacctttacgcaaggtgaagatctgaaatttaccggtatccctaattttgcaccagagttatttcgccgtattcgtttgaaagatccgttgaaacagaaacagctgctcaaaggcttggtgcaactttcagaagaaggtgcggttcaggttttccgtccgttaaccaataatgatttaattgtgggggcggttggtgtactccagtttgatgttgtcgtttctcgtttaaaatctgagtataacgttgaggcggtttatgaaaccgttaatgtggcaacagctcgctgggtagaatgttcagaggcgaaaaaacttgaagagtttaaacgtaaaaatgaacagaatttagcgttagacgggggagatagtcttacttatattgctccaacgatggtaaatcttaatcttactcaggaacgttatcccgatattcagttttttaaaacaagggaacattagtctttgatatgatagacaaaagagcggagatatttccgctcttttttgttgtttaaatagggaaagttgctcggtttaaatgcggtttaaagcgttttgcctattttcaactcgcattaatactcttgaacttcttcgtgtttttctaccgcacttttgatggttaattgcacttcagtagaaataattctatcgagaatatcgctaatgtcatttaatttctccgttatagcgacgccatttttatcaaaatatccgttggatcttaagctaccgataaaagcggaaaagacggctttatcgaaaaattccggtgcattaatgccatgcaatacagataaccgctgtgcaatagattggctttctttctctaaggtcgctttggcaatattcggggtatcttgcaagatactgacggtaatataataacgttgtaaaatttctcgaactcccgccatccataactgtaaaactcttacacgttctttattgattgaaagaagattttctgcacacagaattaatttttgacgtgtaaattcctcaataattttttgaacatattcatctaattcatcttgtgaaaagtgtaaaaataattcctcttttaagaaagggtaaatttttcgagctgcatttgataccaactctttttgtattgcaccatgatgaaaaatgatgcttgcaattaaagaaggtaaaacaaaaacatgttggatattattacgataataggtcatcaatactgctgctgaacgttctaaacgcaacatttcaccaaaattatctttttctacgataagtccgactcgttctaagtttaatacatgagtgagtatttcttccggtgtatcagtcggtacaataatatcgttggaataaggggcgtgttgtaaaaagcgttgataacttttcagttgttccaacagttgttcacgagataaagcacgttggcgagaagacaaaagtgcggtacccgttaagttcattgcattaattgccgctgctttgttgatattgatcatgacttgatttgaaatggcattaactgcagggttaaaccattgagaatgatcttccagctggctatctttccattcaggaaaatgttgatttaagtaattacttaatgtaataggttcggcaaaatttacataaccttgccctaaattgcgtaatttgcggataacacgcaagaccaaaccggcgttttctttctcttttgccgccccccgcaattcttttgcgtaagtatctacctctaatacatgctcatagcctacataaaccggcacaacggaaattggtctgatttggttttgttgtaaggcttgtacagtcatagacatcatgcctgttttcggggcaagtaaacgtccagttcttgagcgaccgccttcaataaagaattccacagagtagccacggtgaaataattctgctaaatattcacggaaaatggttgaatataatcgattccctttaaaggttcggcgaataaagaatgcacctcctcgacggaacatcattcccaccggccaaaaattgaggttaatacctgcggcaatatgtggaggcactaacccttgatgatatagcacataggacaataacaaataatcaatatgactgcgatgacaaggaatatatacaatttcatgtccttctaatgctaatttacgtacacgttccgcattttggacatcaattccttgatataatttattccataaccagcctaaaaaacgatctgcaacacgcaatccctcgtagttcacattggcggcaatctcatccaatatcttatatgcttctttacgtgctttttctttgctgattctcttacttttcgcttcatctgcgatggcattgagaattgccggtgattgtaataatttattaaacattgcttggcgattaggtaagcgaggacctgtagcggacattctttgtttggcaaaatggatttttgccactcgagcgagttttaaagcaatacttgcatctgttccatattcatcagccatatagcgtaaagaaaccgcttgtgaaaaacgcacaaaagtatcacgcccaaaccaaatagccacagctgttttttggatactatttaataaacgaagttttggtaagccaacctgcttttcatgacccggagaacgtccccaaagtacggaaacaggcactaactgtacatttaaatcaggtaaagagcggtgtaattcaaggtatttttcaactatctgaatagtcgctgacttagcacctttcgatttaaaaaaacgtctaccttcgtctaaaaatacataacgaggtaaacattgcccccccaattcattctcttctaagggatcaggcaatcctacgcttaagcaatttttacggataataattaaatctgtttgtgaagtgtaaggtaataaataaatgatcggttggctaatatctaatgataattcttcgataggttgttgcggtatagggttatttttaactaaaaaagagagagggacggacaaaagattacgataaaaattaagaatacttgacataacaatttccattaacttattaggttgattggctaatgaatactattctaacaaaaaaaatatttttttattaataaattaatttattgaaactaaagattgatgtaattttatttctgtatataatgtcatatattctgtatataaaaacaggggttagtatgagttcaataaaatcattaacgacacgacaacaggaagttttcgatctaataaaacgtcatatcgaaagtacaggaatgcctccaactcgagtggaaatatctaaagaattgggatttcgctctccaaatgcggctgaagaacatttaaaggccttggcccgtaaaggtgtaattgaaattgtatctggtgtatctcgtgggatcaggctattaacggatatagaagaaccggaaaatgaaggacttccgctgattgggcgagttgccgccggtgaaccaattttggcggaacaacatattgaagcaacttatcaagtcgatgctaatatgtttaaaccgcaagccgactttttattgaaggtttatgggcaatctatgaaagatattggtattttagatggtgatttgttggctgttcatagtacaaaagacattagaaatggacaaatcgttgttgctcgaattgaagatgaagtaacagtaaaacgctttgagcgtaaaggttcggttgtttatttacatgcggaaaatgaggaatttgagccaattgtagtagatctaactcagcaaccttactttgaaattgaaggtatcgccgttggcattattcgcaacaatgcttggatgtaaacatgacatcatgcagtaaatttgttatttaaaaatgagtagcggaacaaaaataagccaacaactatttgttggcttatttttaactatctagcataaatctcagcttcggcaaaaaaataggcaatttcacgttgtgcattctctaaactatccgagccatgaacggaattttgggtttgattaatagcaaattcataacgtaatgtaccattttctgctatttccggattagttgttcccataaaagtgcggtagtcttttaccgcattttctttttgtaacaccaaaacaactataggggcagatgtcatgtatctaatcaattcagcaaaaaacgccttatcgctatgttcagtataaaaaccttccgcctgttcttgatttaaatgcaacatcttcatagcaatgatttgaaatcctttgtcctctagacgagaaatgatgttacctattaaatttcgttcaactgcatcgggctttataatcgctaaagtttgttctaatgtcataggtctctccattattcagctttatttaataaaaaattcgccaaagtttgtacaccgattcccgttgcacctgttgcccataagtcacttgctgatttacgataagttgccgaacaatcaatatgtaaccaattttcttgataattttctacaaaataagataagaatgccattgccgtacttgcaccggcacccattggaacagtcccaatattggcaatatctgcaaaggatgaactaatttggtgacgatgtaattcgtcaaaaggcaatcgccaaaacggttcttttgtactctttgcacaatcgaaaaactgttgagtgagttcgttatccattgaaagtatcgcatgataatcattaccaaccgctacttttgctgcaccggttaaggttgcgcaatcaagaataaatttaggcttcgctaaatccgcatcaattaagccatcggcaagtaccaaacgcccttcggcatcagtattaagaatttccgcactgataccattgcggtagtgaataatatcacctaattttaaagcgttgtggctcaccatattttcagcacaacataaaaatagtttaactcgtttgttaagccctccggctattgccatacctaatgcacccgttaatagtgcggcaccgcccatatctgttcgcattgtactcatgctatcacttggtttaatgctgtaaccaccactgtcaaaagtaattcctttaccgactaaacaagccagtaccggtgcattttcatttccggtaggattaaaatccagctgtaacatagctggtaaattttctgagcctttacctacttgccaaatcccttgatagtttttttcagcaagttcttgtccggaaataatttgaaaagataccgcactttcgtcagcataaagacttgcttgttcggtgataaattgtgccgcacgctttgcaagttcaataggggtgataattgaagaggggagattaataatttcacgcacaaaatcgccacattgaattcttgccagcaattcagcttgtggctcgtcctctaaatgaggaaattcaatagtataatcttgtttagcggtataaaagccttgatagaatgcccaacaattttctaaatcccattctgatccaataagttcaacttcttttattccttggttgcgtaattttcgagcggctttttgaattaaagaaatgtcttggttacgtgtcggatgatgaatgatggcttgatcgtgagtaaaactgattaaagcttttttcccccattgttcttttgctggtgaaatttctatcttaatttgcatactttatccttaaatttacttgataaaaaaactgatatagatggcactataccagtttttcttgaggtaacaagaatgaatagggagaatgatcagaaataaagtctaattagcgtaaaaaagcaggaatgtttttttcatactctgcgattttatcttcatgttgcaaagtcaatcctatattgtccaatccatttaataagcaatgacgacgaaattcatctaattcaaaatgataaattttatttcccgttgtgacggttaaattttctaaatttacatgaatttcacaacctttatttttccatacccattgaaaaatttcttccacttcttcttcattcaaacgaatgggcaacatatgattattcaggctattattatagaaaatatcagcaaaactaggtgcgatcatgaccttaaatccataatccgccaacgcccaaggtgcatgttctctagatgacccgcaccctaaatttttgcgtgcaagtaaaatcgttgcaccttgatactcgggaaagttcagcacaaatttaggattaggtactgtaccttcctcatcaagataacgccattcgtggaataagtgttttccaaaacccactctggtaatagcttgtaaaaactgttttgggataatcgcatcagtatccacatttgcggcatcaagaggaaccactaaacctgaatgttgtttaataccagccataaatcttccttaatttaattccatataacgaatatcaacaaatttaccgaagacagccgctgccgctgccattgccggacttacaagatgggttcgtccgttacggccttgccgcccttcaaaattacgattactggtcgaagcacaacgctcccattcaccaagtcgatcatcattcatacccaaacacatagaacaaccgggattacgccattcagcaccagccgcaataaaaattttatctagcccttctttttctgcttgttctttaaccaatcctgagccgggaacaacaagtactcgttttacgttatctgcttttttgcgacctttcattactgtagctgccgcacgcaaatcttcaatgcgggaattggtgcaagatccgataaatacttgatcaacggaaatatcttttaaatcagtttccggagataagccaatataagctaaggctttttctgcggaggctttggtgacgggatcttgcatttctgctggattaggtactttctgatcaataccgataacctgacctggattggttccccatgttacttgtggagcaatgtcttttgcgtctaatatcaccacagtatcaaactctgcaccttcatcggtttttaaggttttccaatattctaccgcactttcccagtcttttccttttggtgcataaggacgatctttcaaataagcgaatgtggtttcatcaggtgcaatcagtccggctttcgctcccatttcaattgccatattgcaaactgtcattcgtccttccattgacaatgcacgaatagcttcaccacaaaattcaacaacatgaccggttccccctgccattgtggttttaccgataatggcaagaataatatctttggcagtaatgccttttgcgacttcgccacgtacttcaattttcatacttttggctctggcttgttttagtgtttgcgttgcaagaacatgttccacttccgatgtaccgataccaaaagctaatgcaccgaaagccccatgagttgccgtatgggaatcaccgcaaacaatcgtcatgcccggtaaggttaatccttgttccggccccatgacatgtacaattccttgctgtttactgttcatatcaaacaaagaaattcctgttgctttacaatttttatctagctctaaaacctgaattttcgcttgccctgttaatttgtttacgtcacgcacttgagtagaaatactatgatccattgtgccgaaagttttattcacttgacgaacctgacgacctgctacacgcaatccatcaaaggcttgcggtgacgttacttcatgaattaaatgacgattaatgtacaaaatcggcacttctcccggtgcttcatgtacaatatgagaatcaaataatttttggtagagtgtttttttcatatttattccgttaagtttttttcactaattaggtaagtgcggtagaaaacgagaaattttggctaaatttaccgcactttatttttcattctctattgcttaaattgcgtttacaattaagtctcccatttcagctgtggaaattggcggatgttcatctgctaaatctgcggttcgataaccttgagaaagaacctgtttcactgcgttttctattgaatccgccgcttcatttaagttaaagctataacgtagcatcatggcagcagatagaatttgagcgattgggttggcaatgcctttgcctgcaatatccggagcagaaccacctgccggttcgtaaagcccaaaaccatgttcatttagactggcagagggtagcatacccattgagccggtaatcattgccgcctcatcagaaataatatcgccaaaaatattagagcaaagtaagacatcgaaaaattcaggttgtttgatcaattgcattgtcgcattatcaatataaatatgatccaatgttacgtcaggatagttcttggcaacctcattgaccgtttcacgccataataccgagctgattaatacattggctttatcaacagatgttacatgtttacgccgtttcatcgctgtttcaaaagcaactttagctatacgttcaatttcatatttgtaataaacttctgtatcaaaggcacgagtttgcatttcctctccatctcgtcctttaggttgaccgaaataaatgccgccggttaattcacgaacagtcatcatatcaaatcctttggcagcaatatccgctcgcaatggacaaaatttttctaaaccttggtaaagtgtggcaggacgtaaattacaaaacaatttgaaatgtttacgcaatggtagtagtgcacctcgttcaggctgctgattagggggtaaatgttcccattttggtccgcctaccgagccgaataaaattgcatcactttcttcacagccatttaatgtagaagcgggtaaaggcgtaccatgattatcgatggctattcctcccacatcaaaagtgcggtaatttaatttgaaattatattttttttgcactgcatccaatacttttatagcttccgccataatttcaggaccgataccatccccacttaatactgcaatagtataacttttcatgatttttcctctttacatcaactttactgtgaaattttatgcgattttaaatctgccactttattggcacgataaatggcattgattgcatgaattaaggcacgagccgaagattctacaatatccgttgccaatccgacaccatgaaaacgtcgccctttatgttcgacaacaatatccacttgtcctaaggcttctgctccctcaccttttgcagtcaggttataatgcaacatagttatatccatatctgtaattgctaaaatagcgttataaacggcatcaacaggaccatttcccccatttgaaacttggctaatttttttaccgtccagttcaacttgcacaaaggcagaagccggtaaattactgattgtttgagaagtaataacatccaaacttagccgatcttcatcaccctgttgcatatcaataaatgccaatgcttccaaatcataatcaaatacttgcccttttttatcggctaattttaaaaatgcggcgtataatttatccaaatcataatcgttttgttgataacccattgcgtccatatggctttttactgctgcacgtcctgaacgagcggttaaattcaatttttcttttttcaatccgatggtttccggcgacataatttcgtaagtatttttatttttaaccataccgtcttgatgaatacctgaagaatgtgcaaaagcatttgatccgacaatagctttattcggctgaattggcatattacacaactggctaaccatctgactgacacgatgaatttcttgtgtattaattcgtgtatctaagcccttaaatatatcttgacgtgttttaattgccatgactacttcttccaatgcagtatttcctgcacgctccccaatgccattaatggtacattcaatttgtcttgcaccgttttgtactgaggtcaacgaatttgcagtcgccatgcctaaatcattatggcaatgcaccgaaattactgctttatcgatattcggtactctgttcatcacttgatcgatgatattaccgtattcggttggtaaacaaaaacctaccgtatccggaatattgactgttgttgcacccgctttaattgctgcctcaacgatgcgacaaatgttgtcaacacctgttcgaccggcatcttcgcaggaaaattccacatcatcggtataacgtctggcacgttttactgcttgtattgccatttccacgacatcatcaaaagtgcggcgtaatttagcttcgacatgcaaagcggaagtggcaataaacgtatgaatacggaacgcttcagctacttttaatgcgtcagccgcaatatcaatgtctttatccactgcacgggataaggcacaaacacgactgttttttatatgacgagcaatggtttgaacggattcaaaatcccctgctgatgatactggaaaccccacttccattacatcaacacctaaacgttccaacgccaatgcaatttgtaatttttcttttactgttaaactggcttttaatgcctgttcaccatcacgcaatgttgtatcaaaaataataatgttgttttgcataactctttccttcttattttgtatgttgccatctgcaaagtgcggtgcttttttattgattttagatacaaaaaaacccgcattctacttgtgcgggtcaactgacatgtttaactatacttctttgttccacaatttatccgcacaagaaatgtgatagtcgtaaattgagtaacagagaaagaatgtcaaacataaaatatcctaaaaataaaccaagatgggtttatattacgagtttaaaatgatgtgtcaaatgattttttagtgttttataccaaataaaaggttattcaaaacataagtttaatacataaaactaacttttaataatttaatagtgttaaaatccacatcgttaaaaaattttaattttttctaccgcactttagctctttcatagtaatgaaagtaaatttgtgtttttttgggggttctaaaaaataacttatcggcgttctttgagttgattttgttttaaatcaaataatcctatcatatacaactaaagagttatgcttttaacgtttcattttttacaccatgagtatagcttatgatagaatgcgtctccgaaaatgtttaaataacttcttatgcaaaataatcatctacaactggaacaacttgcctgtcagcgtggcgataagattttgtttactgacttaaatttagatgctaagtcgggagattttgtgcaaattgaaggacataatggcataggaaaaaccagtcttttacgaattattgtgggacttagtttccctgctaaaggtaaagtgcgatggaataagatcgaaattaataaaaatcgtgaagaataccagcacaatttactctatttggggcatcttgctggaattaagcctgaattaagtgcttgggaaaatttacagttctatcaaaaaattggtaattgtcgacaaagcgaggagttactttgggatattctacagaaagtggggttattaggtcgagaagatttaccggcaggtcaactttctgcaggacaacaaaaacgtattgcattagcaagattgtggttatcaaatgcggcattgtggattttagatgagccttttacagctattgataaacaaggtgtcaacgttttaactcagttgtttgaacaacatgtggaaaatggcggtattgtgattttaaccagtcatcaagagattccgagcaataagttgcaaaaagtgcggttagatcaatacaagttttttgatcaagggaatatggcatgatttttgtacaaattatcaaaagagagttaaaaattgcttgtcgaaagcaagctgagatcttaaatcctttatggttttttttgattattttaaccttgtttcctttggttattggtccggatcctaagctattagctaaaatagcccccggaatagcttgggttgccgctttgctatcggcattactttcatttgagcgtttatttcgtgatgattttgtggacggttctcttgagcaattgatgttgacagcacaacctttagcgatgaccgccttggcaaaagtcattgcacattggcttttaaccgggttaccgttaattttactttcgcccattgccggactattactttcattggagttgcatatttggtgggcattagttttaacattgttgttaggaacgccaaccttgagttgtttgggagccattggtgtggcacttacggtagggttgcgtaaggggggcgttttgctgagtttattagtcttacctctatttataccggtattaattttttctgccgctgttttagatgctgcaacattaaatttatcttataacgggcaactcgcaattctgggagctatttttgtttcagtggcaacactttcacctttcgccatttcaattgcgttaagagtgagcttagaccagtaattaacttagtgaagatttgttttttaaataacatagtaaggacaacatgatgtggaaatggttacatccttatgcaaaatcggaaacacaatatcacttatgtggtaagtttgttcctttgtttgcaacagtatctatacttttattaataaccggcgtaatttgggggcttgcttttgcaccggctgattatcagcaaggtaacagtttccgtattatttatattcatgttccggcggcaattttttctatgggaatttatgtgtctatggcaattgccggagtgattggtttagtttggcaaattcgccaagcgtatttgagtattctcgctatggcacccatcggtattgtgtttacttttttgacattggtcactggagcaatttggggtaaaccgacttggggaacttggtgggtgtgggatgctcgtttaacttcttccttgattttattctttttatatttaggcgttatcgcactttactcggcttttcaagatcgtttaatcggtatgaaagcagcagcaattctttctattgtgggggtagtcaatattccggttattcatttttctgttcagtggtggaataccttacatcaaggggcaagcattacaaaatttgaaaaaccttccattgcaacacctatgttaattccgcttattctctgtattttcggttttatggcattaacaatgtggtttactttaatgaattatcgaacccaactgttaaaagatgagagcaaacgcccttgggttaaagcattagtaaaataggagtttattatgttttttcaaagttggagtgattttttttatatgggcggtcatgggctttatgtctggctatcttatgggatttctttccttgctattataggattaggcttgcaaaatatttatcttcgcaaagccctatttaaagaaattcaatgtgaacaattgcgttcagtgcgtcaaaaaaatacgcaagctgaaaacaatggagaaaacctatgaacccaagacgtaaatcaagattatcggtagtactgtttattttcctgggcatatccgttgcctctgctttagtgttgtatgcgttgcgtcaaaatattgatttgttttatacgccaacagaagttgtgaatggaaaaaataacgaaagccataccaagcctagtattgggcaacgcattagaattggcggaatggttgtggaaggaacggtagaacgtgatcctaaaagtttaaaagtcagatttgacttaaatgatattggaccttcagtaacggttatttatgaaggtattttgcctgatttatttcgtgaaggacagggcattgttgctcaaggtgtacttattgagccaactgtactgaatgcaacggaagttttggcaaagcatgatgaaaattatgttccgccggaattagaagcacaaatgcagaaaattcataagcctatgggcatatcggatctcaagaatgaaagtgatcgtgatcgtcaagaaaaacaatttaaagaaggtaaccaatgatcgctgaattaggcaattatgctctggctttaagtttagctatttctgttttattatctatttttccattatggggggcggaaaaaggcaatgtgcagatgatggctttagctcgcccaatgacctatggtttatttgttagcttaactgtttcttttgttgcacttttctatttatttctgacaaatgatttttcagtacaatatgtggtgaacaattcaaataccaacttacctttgcaatatcgtctatccgctgtttggggctcccacgaaggttctttattactttggatttggctattgactctttggagtgcggctgtggcttttttgagtaaacaattaccccaagaagctgtggctcgtgtcttggcaattatgggtattattacgattggtttcttactatttgtgatgtttacttctaacccttttgaccgcactttccctgattttcctgttgagggaagagaattaaatccattattacaagatattggtctgatttttcatccgcctttactttacatgggctatgtgggtttttccgttgcttttgcttttgctattgcatcattgatgacgggaaaactggataccgcatgggcaagatggtcccgaccttggacaatggctgcttgggtatttctaacattggggattgtgctgggatcgtggtgggcatattacgaacttggctggggcggttggtggttctgggatcctgtagaaaacgcctctttaatgccttggcttgccggtactgcattgcttcattctcttgcggtaacggaaaaacgtggttcatttaaagcatggacagtattgctggcaattttggctttttcactgtgtttattaggtacttttttggttcgttccggtattttggtttcggtgcatgcttttgcctctgacccaactagaggtttatatattttagcttatttaattgtagttattggcggttcgctagcgttatacgcttataaaggcaatcttattcgcacaagaaacaatgctgaacgttattctcgagaaactatgttgttaatcaataatattttattaatgaccgcacttagtgtggtgttcttgggtactctcctgcctttagtacacaaacaattagggttgggaactatttctatcggctctccattttttgatcaaatgtttttattgatcatgattcctttatcacttttattgggtgtcggacctttagtaaagtggcgtcgagaccaattctgtgctattcgtcttccggttatcatcagttcaattattatgcttattaccggatttgttttaccttattttttacaagatcgtattgcagtgagtgccgttcttggtgtcatgatggcaatgtttattcttcttctagcactctatgaattgcagcaaagagcaacgcataagcatagcttttggattggcataacaaaattgtctcgttctcattggggaatggttttagcacatttaggggttgcgatgacgatatggggaattgcttttagccaaaattacagtattgaaagagacgttcgaatgaatgtgggggatacagtaaaaattgcagattatgaatttactttccaaggtatatccgatgtcaatggtgtcaattacttaggcggaaaggcacaaattgacatcagtcgaaacggtaagtttgaaaccacgttgtttgctgaaaaacgtttctatacagtgagtaaaatgacaatgactgaagcggctattgattgggggttatctcgagatctatatgttgcactgggcgaaagtttaaatgatggttcatgggctttacgcttgtattataaaccttttattcgttggatttggctgggaggtatatttatggcattcggcggattactctgtatatttgaccgacgttatcgttttggaaaacttctaaaacaaggataagttatgaataaaaaactttatataccattaattttattcctcggactagcctttgctttttttgtgcaactgcaacgtaatgcacaaagcgataatccaaaagcattggaaagtgccttaataggtaagtcggtgccaaataaactgctaactgatttactgacagataagcaatatgacaatcgtctattcaaacagggtaaacctttgctcgtcaacgtttgggcaacttggtgtccaacttgttatgcggaacatcaatttctcaatgaacttcataaacaaggtattaacattattggcattaattataaagataaaacggataaagccataaaatggatcaaaaagttaggtaacccttatcaagtaattgtaaaagatgaaaaaggatcttttgggctggatctcggtgtttatggtactccggaaacgtttatcgtggatggaaacgggattattcattaccgccataccggtgatataaatgaacgtatctggaaagaaaaaatacagccaatttatcaacaagtaagtgagaaaaaatgatgacaaaattacgttattttctgaccgcactttttctcagtttttcagcacaagctgcgattgatgcacttaattttacctctatgcaacaagaaaaagattatcacagcttgactcaagaactgcgttgtcctcaatgtcaaaataacaacattgctgattccaatgcttcgatcgctgtagatatgcgggcaaaagtgtatgaacttttacaaaaaggtcaaaataagcaacaaattatcgattatatggttgaacgatatggaagttttgtgacttataatccgccggtaacaggttcaacaatcattttatgggttgctcctttggctttgatgattcttggtgttgttattgtgctacgccgtaaatccggttcatccggtaaaagtgcggtagaagctcagccaaatttaactcaagaacaacaaaagcgtttagaagaattattaaaagaacgggaataaaaaatgattttttgggtaatttgccttttattaacattagctattgcatttatttgtttttatcctctgcttagaaacaagacagaacaatcaaccaatttaaaacgagatgaattaaataaggccttttatttcaataggttgaaagaaattgaggaagacgaacaatacggtttattagaaaatagtcaagagtttaaaacagaattacaacaaacgttgttggaagatattcctgaaaaaatggctgttgagaagagtaataagcaatacggacaaatttggtttatttccggttttttgactttagcgattattgctcctttaacttatatgagtgtaggttcttggcaatctgagataatgttagaaaaaacttacgaaaaattaccgcacttttatgcaagagtaaaagaggaagcaaacaaaccgctaaatgaaaatgagctacaacaatttgctgttgcactgcggttaaaattacaaaaagaccccaataatgcggctgattggtggacgctaggacaagtggcaatgaatctggaaaaagcacaacttgcttttgatagtttttctcaagccaataaattagcaccgcagaatattgaatataagctatcacttgctcgaattttgatgttttcacaagatcaaattgatcgtcaaagagggatgaatttattaaaagaagtgttgcgtattgatcatactaatatgcaagccttaagtttgcttgctttccagtattttgagtcggaagattatcaaagagccgctgtaacttggacaatgatgcttcggttcatgccgaaaaatgatccaagagttcctttaattgaaaaaagtattcgtacagcacgtgatgctatcaaagaagatagcaaataaaaccggttatatatgaaaaatttaaagtattttgcacaaaaatatgtggattgggttattcgcttgggaagaattagattttccctattaggtgtttgtgttttggcagtggttgctttgcttacacaaatagtggtgagtttaatttttatgggaactatctattggcaagatgtagctcgttctattatctttggtttgttttcagctccttttgttttatatttttttacgttattggtagagaaattggaaaaatcacgccttgatttagcgaagttagtggataatttacgcaatgaggtatcagagcgtattcttgctgaaagaaagttatcggttgcgttgagtgagattgaaaaaaccagtcaagataagaccgcacttatgacaacaatcagtcatgaattgcgtacccctttgaatggcattattggcttaagccagattttgcttgatgacaaattaacagagcaacaacgtaattatcttaaaacgattaacgtgagtgctatttctttgacgcatatttttagtgatattattgatctcgaaaaaattgatgctaatcgtatagaattacattatcaaccgactaatttgtgcagctttttaaatgatattaccaattttgctacattaatggcggcacagcgtaaattaaagtttgaattggtgtgcgataaagatttacctgattggctgatgttggatagcgcaagattaagccagatattatggaatttaattaataatgcagtgaaatttacacctgccggaaaaataaaactgaaggtttctcgcttgacggatgatactttttcttttgcgttatctgataccggtgttgggatagcaaaaggggagttggataaaatttttactatgtattatcaagtacaagaaaccgatcataaacctatcggtagtggtatcggtctggctgtgtctaaagcaatagcaggtttaatgggcggtgatttaaccgttgaaagccaattgcatcaaggggcaacctttacgctcactttacaggctaaagctgtagaaaaaccggcagaaagcgaatctaatgtgcctaatacattgacgatcctattagttgaagatattgaggtaaatattattgtagctaaatccgtattggagaaattaggttactgtgtggacgttgccatgaccggtaaagaggctattcaaaaatttgagcaaaattattatgatttggtgctgttggatattcaattgcctgatatgtcaggatttactattgcacaatatttacgtgaaaaatatgaacaaggtgtttatgattttctccctcctttaattgcattgactgctaatattatgcaaagtaaaaccgaatatcaaaaacaaggcatggatgatgttttacgtaaacctttatctttagaggcgttagtaaattgtttatcggattatttcggtgatgagttaaatacaaagattattaaaaaatcctctttcgtagagttttctgctttatccgatgttcttaatatggaactgttggttgagctgaatgatattttaggtaaagaatttattggtaaaaacctattattatttaagcaaactatgccaagctatgtaaatgaattattagatagttatgaacaatataaacaggatagtgcattaaaaaatgatttactttctaatgtgcataaaatcaagggagcagcggcatctgtcgggttacttcgtttacagcaagttgcctctttagctcaagatgctaaccacgaaaattgggaaacgcatatcgatgagtggatcaataccttggcaaatgattggttggttgatacggcgacattagaggattggttgaatgatctgtaatttattaaggaataatagttgcaaaaaggggagtacaactttaaacttgagcctttgccattgatatagttaacactcgaataattatgacaaatttaactgaaaaactggaagaaactgccagcaataatgagcttttattaggtgagcgttttcgcatggctcgtgaaaaattacagttgtctttagatgatgtatctaaacaaattaatttaagacccgctattttacagcttcttgaaaataatgagtttacacataagagcattcctacaactttcatgaagggttatgtgcgtaattatgcgaagtttctacgcataccggaagaaatatggacaaaagcaatttcctccgtggaggaaaatacacgccataatttaggtaaaaatacttgcttgatgaaagcggtaaatgggcattcttctcatgggcgttggattggttatgtaacggtattggtgttgttgattgtatccggtatgacggcgttatggtggtggggaaattaccaaaaatcaaatcaagaacgtgacacttttgtacaacattatgtagaaaatgcaccatcggagcggattgaaattcaagcggatcaagtgcttgaaaaaaatttaacgatccctgtggaaaagccacaggttgtttctgttaatgaaactactgttgtaaataaagacagtatggcagaaaataagttgacctcagtttctacgcaagagcaaagtgcggtacaaaatccacaagaaatagtgagcaacaaaacatcagaaactgaaaaaacggttaaaaatacagaaacctttgtcggcggtgatttgcaaatagaaattatcggggccagttgctggattagtgttaaagacgctaaacataaagtattagcacaaaaagaatataaacaaggcgaagttttggtctttactgatggatcaccttattctttgattatcggtgtcccaagcaatgttaaaattacttacaaaggtgaacattatccattaaaagttgacggacgtgttgctaaattcaaattacagtaaattattatgtcatcgtttaaaccaactattaatcgtcgtcaatcgacaaaaatttatgtgggaaatgtaccgataggtggtgatgcacctattgccgtacaatctatgaccaatacaagaacgactgacatagaagcaacagtggcacaaattaaagcattggagcgtgtcggtgctgatattgtgcgtatttctgtgcctactatggatgcggcagaggcgttcaaatcaattaaacagcaggttaatattccgttagttgcagacatccactttgattatcgtattgctcttaaggtggcggaatatggggtagattgtttgcgaattaatcccggtaatattgggcgtgaagatcgtattcgtgccgttgttgattgtgcgaaggacaaaaatatccctattcgtataggtgttaatgcaggatctttagaaaaagatctacaggaaaaatatggcgaacctacaccggaggctttgctggaaagtgcgttacgtcatgtggaaattttagatcgtttgaacttcgatcagtttaaggttagtgtgaaagcctcggatgtctttcttgcggtagaaagctatcgcttattggcaaaagcaattaaacaaccactgcatttaggaattaccgaagccggtggagcacgtgccggtgcggtaaaaagtgcggtcggtttggggatgcttttagcggaaggcattggcgatacattacgagtttctttagcagccgatcctgtcgaagaaatcaaagtcggttttgatattttaaaatctctacgtattcgttctcacggcattaattttattgcctgtccgacttgctctcgtcaggagtttgatgtgattggtaccgtcaatgcacttgagcaacgtttggaagatattgttacaccaatggacgtatccattatcggttgtgtggtgaacggaccaggcgaagcgttaatttcagatcttggggtaacaggcggtaataaaaagagcggttattatttagatggaaaacgtcaaaaagaacgctttgataatgaggatttaattaatcagttagaggcaaaaattcgtgcgaaagtcgcacagcaagatccaaaaaacagaattatctaaaggaagaatattgtggcaaaaacaattcaagcaattcgaggcatgaacgattgttcacctactgaaagtctcttgtggcagtgggtagaagaaaaagtgcggtcggttttacaaacttatggttattctgaagttcgaatgcctatcgtagaaagtacccctttatttgctcgtgctattggtgaagtaacagatgttgtatcaaaggaaatgtacacattttgggataacgatgaacaattaactttacgaccagaaggtactgccggatgcgtgcgtgcggcaattgagcatggctggatttacaataatgaacaacgtctttggtatatgggacctatgtttcgtcatgagcgtccgcaaaaaggacgttatcgtcaattccatcaagccggtgtagaagtgtttggtatagcgaatccggaaattgatgctgaattgattttattaactgctcgtttatggaaacaactgggtatttttgatcatgtaacgttacaacttaattctatcggttctcttgagtctcgacaaaattaccgttctgcattagtggaatttttacagcaacatacggatctattaagtgaggaagaaaaagaacgtttagtgaaaaatccactacgtattttagatacgaagaatcaggtgctacaagaagtattaaatgatgcaccgaaattattggattatttagatcaagagagtcgagaacattttagccaactatgcgatttattagattccgtcggtattcaatatgaaatcaatcctaaattggttcgaggtttagattactacaataaaacggtgtttgaatgggtaacttccgctttgggggcacagggtacagtttgtggcggcggtcgttatgacggtttagtcgaacaacttggcggtcatgcaacttgtagtgtgggttttgctatgggattggaacgcttggttttactggtgcaagaagtgaataagcaaatcgttttaccaagtgcggtagatatttatgtggtttattttggtgaaaaaacgactttacctgcattccagttagctgaaaaaattcgtatggaattaccgcatttacgcacaatgacacattgtggtggcggtaactttaagaaacaatttaaacgtgcggataaagttggtgcaaaatttgctctagtgattggcgaaaccgaggtgaaaacacggcaggttgtcgtaaaagatttactgggtggtgccgagcaattgagcttggcattaacagatgtagttatttacttaaaacaagcaattactcaataaggatactaaaatggcttatacaatcgaagaagaacaagaactgaatgaattaaagacttggtggaaagaaaattacaaatctattattgtaattgtggttcttgccttttcaggcgtatttggttggcgttattggcaagattaccaaacaacgaaaaaacaaacactttctgcacaatatgatgaactgatcagcagtgccgaaaatcaaagcatctacaatgctcagctggatcggtttgtgcaagaaaatggagaaacaacttatgctgtgtttgccttgttagataaagctaaacttgaagtcagtcaacaaaattttgtgcaagcagaggaaacattaaagcaggctattgtgaatacgagtgatgatattttaatgtcaattaccgcaattcggctagccacagttcaataccagttacaaaagtttgatgaggctttagcaagtcttaatcaagttaaaggtcaatcttgggatgttagcaagttgttattgtccggtgatatacagttggcaaaaggcaataaagagatagcaaaggacaattttgaacaagcactaacaaaagccacatcttgggaaaaatcattcatccaagtcagattaaatagtctgtaattgtctaattattgaagccttgatacctcaaggcttttttataggaagttatttatcatgaatattcaacacttattgaaaacacaagcctatattaatggagaatttatttctgccaaaaatcaccgcacttttcccgtgataaaccctgctaatcaacaggttatttgtgaaattgcctgttgtggtaaagaggaaacagaattagcgattaaaagtgccaaacaagcacaagtacattggaaaaaatatacagcaaaagagcggtcaaaaattttaaagaaatggtttgaattgatcatgcaacatcaagaaagtcttgcatatttattaagtttagaacaaggaaaaccgcttagtgaaagtcgagctgaaattgcttatggtgcaagtttcgtcgaatggtttgctgaggaagctaaacgtgcttatggtgagattatcccccaagtgcgggaagaaaatcgcttactggtgattaaacaaccggtaggggtagttgctgcaataacaccttggaattttccaaatgcaatgatcacacgaaaagccgctccggcactggctgcagggtgtgccattattattaaacctgcaccggaaacgcctttatccgctttagcattggcagcattagccgagcaagcgggtataccgaaaggtatatttaacgttttaccgacagtatatgcagaagaagtcggaagtgttttaactcgaagtactgatgtacgtaaattaacgtttaccggttcgactaaaattggcaaaattttaatgcagcaatgtgccgatacggtgaaaaaaataagtcttgaattagggggaaatgcaccatctttgatttttaatgatgcagatttagacagaaccgtcgattctgttatagcctcaaaattccgcaactcagggcaaacctgtatttgtactaatcgaatttatgtgcagtcggagatttatcgtgcgtttgctgataaattaaaacaaaaagtgcgatcatttatcgtaggcgattttcagcaagaggcggtaaatattggaccgttaattaatgaaagtgcggtacgaaaaattgaacgacacattgaggatgcgttaagcaaaggtgcaattttaactttaggtgggcaacgccattctctagggggaactttttttgaaccaactattttagaaaatgtgtcgcaagatatgttagtttgccatgaagaaactttttcccctctagcagctttgattcctttcgatacggaagaacaagcaattagcatggcaaatgatagcgagttcggtttagctgcgtatgtgtatacacaagatttcagtcgtatttggcgactttcggaagaattggaatgtggattagttggagttaatgaaggcattatttccaatgaagtctctccgtttggtggagttaagcaatcgggcttgggtagagaaggctctcgtcacggactggatgagtttttagaaatgaagtatttgtgtatgaaagtttagtttgcaatgcaacaagtcaattgattatccctgctgaggtggaaagtacgacaacacgtgtattaggatcggcaattataagttttgaaactgcgagattagacatcggtaaattccttttagttaaggaaaggggctattgccccttatgataattattgacgcacagtatagtcgcctgaacaaacccatttgtaggtggtaagcgcctccaatcccattgggcctcgagcgtgtaatttttgtgtactaaccgctacttctgcccctaaaccgaattgtccaccatcagtaaatcttgtgctagcattaacataaactgcggcagcatccacaagggaaacaaattggtgagcaagtcttggtgatgacgttaaaattgcttctgaatgttgtgtgccgtattcggtaatatgtgcaatggcttgttgaatatctttgacaataacaacatttaaatccaatgaaccccattcttgacgtagctgttgttcttgtacaatagatacttctgcattttgtttttccaatattgaaagcgcggtcggatctgcgtgatattttacatttttgtgtttcaaatgagcgacaagcttaggtaaaaattctgtggcgatactttcttgcactagcagagtttctaaggtgttacatgtactcggacgttgagttttagcattgtcgattacagccaaggctttatcttgctccgcactttcctccacaaatacatggcaaaccccaacaccgccaataatgaccgggattgtagagttttgtttgcaaaactcatgtaaacccgcaccgccacgaggaataatcatatccacatatttatccaatttaagtaattctaatacgaagtttcgatccggatcggtaatagcttgtaccgcatttttaggtaatccggtttgctccaacgcatcttgaattactgttaccaaaattttattggaataattggtttcttttcctcctcgtaagataacggcattacttgtttttaaacaaagtgttgcaacatcgacggttacatttggacgagcttcataaattacaccaataacacctaaaggcacacgaactcgttctaattttgtaccactttctaaaataccgccatcaatgatttgtccgataggatccgacaatgaaataatatgacgaacatcttttgcgatactatttatgcgttccttggtgagtaagaggcgatcgataattgcatcagataatccattttcttttgccagctgaatatccttagcattttctacaagaattttatcgctttgtaattccaattgttcagcgataatttgtaaggcggtatttttttgttgttgagaaagttgagccaaaatcgtagcggcttgtttagcattttttcccatttcttttaaactcatacaatatccttattttgtttttttaggtaatttatcatgcgttttgactttttctgcttcttgctcttgataatcaaaaataggcaatccccattcgaaataaatggcgagcaaacgaatagtgaagccactaattaacgtaataataatgaccaaattttgattaatctgtaattgttgtaagccaacataaataccggtagctaataatgcaacactggcataaagctctttttggaacactaaagggatgcggttacagagcgaatctcgtaatacaccaccaaaggctcccgtaacgatagcggctatacaggtaacagtaaaaccatgccccatgtccaaagcaatttgagcaccaataatggaaaatacgatcaatcctagtgcatctaagaccaaaaaaatggtacggaagtagcgtataaagtgtttgataaaaggagctataaaaacagcgagtatagccgctccggtaacaatcaagaaataatgtgggtttttaacccaacccaagggataatgcccgagcaagatatcccgaatcgatcctccaccgatggctgtcattgaagcaataataataaccccaaaaatatccattttttctcgtccggcagccaatgctccggttatcgcttctgctgtaatgccgataatatagagaatactcagtaacataagtgtccttaaagtgcggtaaaaggattactattttagagtgcatagaacaaagaaacaatgttatttttgagctaacccaagaagttaggcggatttattgcaaggaaaatttaaccggataaaaaagaaattctcatatcatcaaatttagcaaggattattcattagaagaataaagtatttctttataatgtttacggcataccgacatataactatcatttccgccaatttgaatttgctcaccgtctttgactgctttaccttgttcatttaagcgtaaaacaaaattagctttacgtccgcagtaacaaatagttttcaattcttcaagttgatctgcccaagccaacagatatttgcttccttcgaataattctgcttggaaatctgtacgcagaccatagcataataccggaatattgagttcatctaccacattgcttagttgatagacttgtgctttcgttaaaaactgagcttcatcaattaaaatacaatgtaatttttgttgcttaatatgcagtgctatttcagtaaaaagatcagtgtctttatgaaataaattcgcttgtctatgaatgccaatacgtgaactcactttacctttaccaaaacgatcgtcgatggcagctgtataaactaacgtattcatgttacgttcacgatagttataatccgattgtaataaggttgtagatttccccgcattcatcgtggaataataaaaatatagttttgccattatgttaatacccaaccgccggaaataatatatattaagtttgatttttccattatttatcttaaattgctttcagttcagtcattgcccagcggggtttaacgtcaatttccaaaggtgaatattcaccttgttttagacgcaaaaaaccgacgtaagcaatcattgcaccgttatctgtacaaaattgaggttgagggtaaaagacctctccttttaattgtttcatcatatccgctaaagattgacgtaattgtttatttgcactcacaccgcctgcaatgactaagcgtttaaagcctgtttcttttaaagctcgacgacatttaattgctaacgtatctactactgcttgttggaatgcgtaggcgatatctgctttagtttgttcagtgagttcaccttcttgtttaattgcttgattaattgtattggcggcaaaagtttttaaacctgaaaaactaaaatctaagccggggcgatctgtcataggacgaggaaagaaaaaacgttcgggattcccttgttctgccaaacgtgaaagtgcactccctccagggtaatccaatcctaataattttgccgttttatcaaatgcttcaccggcagcatcgtcaatactttctcccagtaattcatattgccctacagcattaacacgaacaagctgtgtatgtccgccggatactaataacgctacgaaaggaaattttgggggattattttctaacataggggcaagtaaatgcccttccatatgatgtacaccaatagctttaatgttccaagcataggcaagcgagcgtgcaattgttgaacctactaaaagtgcacccaccaatcccggtccacaagtgtaagctatgccatcaatgtcttttgcttctaatcccgcttgttgtaaagccgcctgaattaatggtgcggttttacggatatgatcacgagacgctaattcagggacaacaccgccataatcagcatgtaaagcaatttgagtatacagttgattggcaatcaatcctttttcttcatcgtaaatggcaacgcctgtttcatcacaagatgtttctatgcctagaatacgcattttgtttctcttctttattgaatttcgaaatagagtagattctaccttttttacttaaattaaactagcgtattgatttttttaagagaaaaagtgcggtatttaaaagtgcggtattttttagaatttttttattttttcgacatatctcgcaaaattagcttgcttattttctaaatgaatttttttgtattaacctcttaccagttatgagtacggaacaataggaaaaatatggataaccggaatgagctgttactgcgtttgttacaagtgccgaagttgggagcgtccggaataactcaacttttatcgcacatcgatttaaaaacattagaggattatgatgatgttgcgtttcattatttaggctggaaacctgaacagataaataggtggttgtatccggatcttagatatattgaacctgcattattttgggcaagcaaaaagggacattatttgatgaatttttatcaagagaattacccttatttattaaagcaaaccataggtgctccccctttgttatttatcaaaggcaatccggaaatacttgctcaacaacaagttgctattgtaggaagccgtcattgctcacattatggcgagtattgggcaaagtattttgcaacggaattgttccttgctggttttgttattaccagtggactggctttagggatagacggtttttgtcatcaggctgttgtggatattcaaggacaaactatcggggtattagggggaggtttggaagagttgtatcccaaacaacataaaaaattagcacaacaaatgctagattatggcggtgcgttagtgtcagaatttttacctcatcagcctcccaagccacaacattttcctcaacgtaatcgcattattagcggactttctaaaggtgttttagtggttgaggcaacagaaaaaagcggttcactcattactgcacgttatgctttagaacaaaatagagaagtttttgcacttccgggacaaattcaaaatgagtatagtcaagggtgtcatagattaataaaagacggtgcattgttagtagagaatgttgcagatattgtagaaaatttatcgccttttatgcattatgaacgtcaactaacagcaaaacagatagaaacgcaatttccgccggcttataagttacctgcttcaccgacttatcctgaactctatgcccatattggatatacgccggtagggcttgatgaattatcaaataaaagcggattaagtgtagataccttattgatacagctgttagaacttgaattgcaagatctcgttattgctgaaaaagggttatatcgacggacttaaatgttgatataagcgataactgacttgttttgtgtttttttcttttaataattgccaattcgcaggcgttgttaaggttttttctcgttctgtttccacataaataagtgcattggcatgtaaccaattatgctgtactagtaacttaatggcttgttcagcaagattaaagtagaaaggaggatcaataaaaacaatatcaaagtgcggttcggtttgagttttgtttaaatagtgcaaactattttgattaataacgtttgcattggtacattttaatatagcgacatttttattgagctgattagctattgttttgtctaattcaaggaatgtaacattttttgcttggcgtgaaagtgcttcaaagccgagagaaccgcttccggcaaagcagtctaaacaattggaatcaacgatatgaggcattagccaattgaataaggtttccttaacacgatctcctgttggtcttaaacctgtagaattcaaaacaggtaattttctggcacgccaaagtccggcaataattctgacttcccctttgtttttctcttgtatacggtttggttgattttttttcattaaaaattaattatgataaactaaatgcagtttcgtgattttaacagaaaagtgagcaattttatgtcagaagaaaagaaaaaaggtagattttggtcttggttaggattggggcagaaaacagaagattcgatatcagaacagcaaccggagcaacaatcaggacaacaggaaagtgttgcaagcgagcaagaatctacttcgaatatagagcaggttataaaagaaccagagcatattgatgacacttcatcagacttggttttatccgctcatttacaggagcaagaggtaaaagaatactcacttcatgaacgggaactgtctcaaaatactgtaatagaaatagaaagtgcggttgaaaaaacagatatttttattgaagaggatacaacatatcaggctatcaataaggagcagcgagaggaaacaacgattacatcggtaaaagaagtaataccgcaagaacaagaaaaaccggctgaaaatggtttttttagtcgtttagtcaaaggattattaaaaaccaagcaaaatatcggtatcggtttccgcagtttgtttttgggcaagaaaattgatgacgagttatttgaggagttagaagaacaactattgatcgctgatatcggtgtgccaactacgacaaaaatcatcaataatttaattcagcatgcaagccgtaaacaattgcaagaggcagatttactttatcaacaacttaaagtggaattagccgatattttaaaaccggtcgagcaacctttacaacttgataacagtaaaaaaccttatgttatcttgatggttggtgtaaatggtgtgggtaaaaccactacaatcggcaaattggctaatcaattccaaaggcaaggcaaatccgttatgttggcggcaggagatacgttccgtgctgcggctgttgagcagcttcaagtttggggagaacgtaaccagattcctgttattgcacaaagtacagggtcagattctgcttctgtcatttttgatgctatgcaatcggcagtggcacgtaatattgatgtgcttattgcggatacggctgggcgtttgcagaataaaaataacctgatggatgagttgaaaaaaattgttcgtgtgataaaaaaatgtgatgaaacagcaccgcatgaaatcatgctaactcttgatagtggaacgggacaaaatgcaattagtcaagcgaaattgttcaatgaagcggtaggattaacgggtattagtctaaccaagttggatggaacagcaaaaggcggtgttatttttgcgattgcagatcaatttaatttacctattcgctatattggtgtcggtgagaaaatcgatgatttacgcccattccaagcagatgaatttattgacgcactttttgtacaagaagagtaaatgttgaaatacaaatcttagaatgattatcttagatggcaagttattatttagcataaaacgtaggaaattctatactatcgttgactatgcctctaatgataggaagtgcggtattttttatatgaattcaatctagttttaaatcattttacttaacattacttagaaataagatgatcttttcggatgcccaacaatattaacatcacaaaataagttatcacagcgacgaaaatcagccagcccagccaatgtacacgagtgaaaaaggtcatttgtttccagagactgagtgctggtgaataataccaaataaccattcccataatgatcgcagagattaaaactttgacaaaaaagaccgcactttgtcgagtaaaatggtaaatatccgctttagctaatcctcgataaagcaagtaagcattcagtgttgctgacattgctgaagcgatagccaatccaatataactgaacgggatagcgagtaaattaaatcccatattacttaccatagcaataattccgatttttaccggagtttgggtatcttgccgagcataatagccattggctaaaattttaatcagcataaaactcaacaatccggtgttaaatgcccaaagggaataagaggcggcttgcacatcagaaaatgaaaatttcccacgcatgaacagtaccaataacatcggttgtgccaaaacagcaatgccaatcattgccggaatgccaaataataagatcattctgacgccccaatccattgtttgacgaaaatcaaccgcacttttttcaatgttatctgtacgattaacataatgtcgagatagagttggaagaataacggttgaaatcgcaataccaaataaaccgagaggaaattctaataagcgatctgagtaataaagccagctgattgatccagtcattaaaaaactggcaataaaagtatccaatagaagatttatttgatttacagaaacaccgaatagtgccggaatcatcaaggttcttattttttttacgccctcatcatgccaagcccattgaggttttgttaaaaatccagcttgttttaaaaaaggaatttgaaagagaaattgtagcaagccgccaataaagatcccgatagcaagagcaagatcgggactttctaatcgaggagcgagaaaaagagcggtgcaaatcatagctatattgagaagaacgggcgaaaaagacatcacgccaaatttaccgatggtatttaaaattgcaccagataacgccacaaaagtgataaaccataaataagggaaagtaattttgaggagtaaagaggcttgttcaaattttattgcattggagctgtcatttagccaatcaataaaccaacctgtgccaaagatcgccgtaattacaggagaaaaaagcattgctaataaggtcactactgaaaccaatccgcccaaagtacctgatactttacctataaattctctagttttacttaaatcgcctgatttttggtattctgctaaaactggtacaaaggcttgtgaaaaagcaccttcggcaaataaacgtcttaaaaaatttggaatgcgattagcaaataaaaaaacatccgccactacacctgcacctaatatttgtgcagtaataacatcacgaattaaacctaagatacgtgataacaaagtcattgcactgacgataatgcctgatttcaataattttttgctcaaaataagtttcctttcatgaaaaattggcttaattgtatataaattttgtttttaagctatattccaaacgaaaaaactgttaaaattccgcctacatcgtaactaggctcaacaactaaaggcaattgaggaaagctaacgatggttgtttcggttgtgtctcaccgaaatcctcaacccaaattttgctaattgtttattgacaattgtatagaaaaaaggcatattttacgcctttattttttcgtaaactaacagatattttaggagtttgaccttggctaatatcaagtcagctaaaaaacgtgcggttcaatctgaaaaacgccgtcaacataacgcaagccaacgctctatgatgcgtacttttatcaaaaaaacctatgcagcagtagcaacaggtgataaagcagtagctcaagctgcttttgttgaaatgcaaaaagttgtagaccgcatggcatctaaaggcttaattcacgctaacaaagcagctaaccacaaatctaagttagcggcacaaatcaaaaaattagcgtaattttttaaaaccgataaaaacaaaaccgcactttaaagtgcggttttttatcagctgttgattaacgggtactggtactcgttgtcgtacggtttgcacgtttacgctctacctcagttaaaagttttttacgaatacgtacagaaattggcgttacttcaactaactcatcatcatcaataaactctaatgcttgttcaagtgtgagtttcaatggtgtggttaaagtcaaagcatcatctttacctgaagcacgcatattggtgagttttttaccctccagcgggttgacagttaaatcattagagcgactatgaataccaattatttgtccttcataaatttctgcaccatgatcaaccattagcttgccacgatcttgtagggcataaagtgaataagccaaggctttacctgtaccgtttgaaatcagtacgccgttaatacgctggccaatttcacccagttttacatcatcataatggctgaaacttgagtaaagtaagcctgtccctgaagtcattgtcataaattcattacggaaaccaatgagaccacgacttggaataatgtattctaagcgagtacgacctttaccgtccggtatcatatcacgtacttcacctttgcgaataccgagtgcttccatgacagaaccttgatgttgttcttcaatatcaatagtcacttgctcgaaaggctcttgcttgcgaccatcaatttctttaaaaattactttaggacgagaaaccgccagctcatagccttcacgacgcatattttcaattaatacggataagtgcaattccccacggccggatacactgaaaatatccgaatcatccgtttcttctacacgcaatgccacattatgtacaagctcttttttcaaacgctctaaaatttggcgggaagtgacaaatttaccttcttttccacagaatggtgaagtatttacacaaaagaacatagttactgtcggttcatcaacgcttaatgcaggcaatgcttccacattgttaatatcacaaacagtatctgaaatatttaactcacctaaaccggtaatggctataatatcacctgcataagcttcttgagcttcgtaacgctgtaaacctaagtgtcctaaaacctgaccgatacgaccgttacgggttttcccttcaggatcaattaatgtaacaggttgatttggttttactgtaccacgtttaatgcgtccaatcccaatgacacctaaatatttgctgtaatctaattgggagatttgcatttggaacggtgcatccaactcaacatccggcggtgaaacatgttcaataattgcttcaaagagcggatccatattagaagccaatttttcatgttcaagaccggctacaccgtttaacgcagaagcataaataataggaaaatcaagttgttcatctgtggcacccaaatttacaaagagatcaaatacttgatctactacccagtcaggacgtgctccgggacgatccactttattgattacaacaatcggttttaaaccatgtgagaaggctttttgggtgacgaagcgggtttgtggcattggaccgtcaaaggcatcgacaaccaacaatacggaatctaccattgaaagtactcgctctacttctccaccgaagtctgcgtgtcctggtgtatccacgatattaatacgatagccgttccaattaattgcggtatttttcgcaagaatagtaattccacgttctttttccaagtcattggaatccattacacgttcatcagtatcaccacgagaagtgtctaatgtgcctgaaagtttaagaagcttgtcaacgagggttgttttaccatggtcaacgtgtgcaataattgcaatattgcgtaatttttgaatatcaattttatctgtcatttgaataatctagagttataaaaaattaaaaatttcttccgcactttacgtttcaaaatagttcatttttacatctataccgtgcggaaaggtcgccgattatacaactttttgttattaggagctataaaaaaacgacctccgacctttaccgatataaaattccctatcctattcccctctaattgattataatctccgttcaaatttatttccgttcccactaaagtagagagagtattatgtcaaacacaacagctattacgaatgtattcaagttaatcgaagaaaatgatattaagtttgttcttcttcgttttaccgacgttaagggtaaagaacatggcgtttccctgccggtcagtttagttgatgaggacttgtttgaagacggtaaaatgtttgatggctcctcagttgaaggttggaaagccataaataaggcagatatgttattgatgccaattgctgaaaccgccgttgttgatccttttgctcaaattccgacactttcaatccgttgcagtatttttgaaccgactactatgcaaagttatgacagagatccacgctcaattgccatgcgtgcagaaaattatatgcgttcaacaggcgttgcggatgatgtattttttggtcctgaaccagagtttttcttatttgatgatgtgcgttttgatgtctcgatgaacggtaactcttatactgtcgacgatattgaggcagcatggaatacaaataaacactatgaaggtggaaataaagcctatcgtcctttgaagaaagggggatattgtgcagttgcaccgaatgatatcgcacatgatattcgctcggaaatgtgtttgttaatggaagaaatgggattagtgattgaagcccatcaccacgaagttgctacagcggggcaaaatgaaattgccactaaatttaatacacttacattaaaagcagacgaaacgcaaatttataaatatattgtgcaaaatgttgcgtatgaacatggcaagacagcttgctttatgccaaagccgattataaacgacaacggttcaggtatgcattgcaacatgtctttgagtaaggacgggaaaaatattttccaaggtgataaatatgcagggctttctgagaccgcactttatttcattggggggattattaagcatgcaaaagccttaaatgcgtttaccaacccatcaaccaactcttataaacgcttagttccgggatttgaagcacctgttttattggcttattcagcaagtaaccgctctgcatcaattcgtattccggcggttactaatcctaaggctattcgtattgaagcacgtttccccgatccgttggctaacccatacttagcgttttcagcattattaatggctggtttagacggtattcaaaacaaactttatcccggtgatgcaatggacaaaaacctctatgatttaccgccggaagaactgaaagacattcctgccgttgcaagttcattaagtgaagcgttagataatttagaaaaagattatgaattcttaacgcatggtaaagtattcagcaaagaatttattgatacgtttattgcaatgaaacgtaaagaagtggaacgtttaaatatgacaccacatccagtagaatttgaaatgtactacgcttaatactggttagataaacaaaaagcgactaaatttgtttgagctgacctcacaggctagacagatttaatgcaaggactgtgttatatcatttacaggtcgcagtccttttagtttcacgtgaatatattcaaattgttgtaataaagtatctgaaattttcccgactttactctgataagaggatactttcttcgctggcaattcttaattttataccgcactttttactctttttttctcagcgaaacttctcctccgttaaattttctcaatactccattattcaacgctactaatagataaccctcttcatcaataccttgctcaattccacaaacgatttctttttcgctaataatatttacttcttgtccaaaaaaataatccaacttaatccaacgctgaaaaaaagcatgcattccctgttgctcaaaaatagtcaaatattgataccatttttttactaattgaattgcaagatcattacgatctatttccggcaaagtttccaataattccgcccaaggttgatcaattttgttttcttgcggtaaagataaatttatcccaatgccaacgataaaattaagtaatccatttttagcattgacgatttcaactaaaattcctgctaatttccgtccgaacaatagcagatcattcggccattttaacttaacctccgcacccatttcatttagcacttcagcagttgccagtcctaatactgaacttaaaccgtttaacgaaactgtcggattgaatgtccaataaaaactcaccattagttgaccggcaaaaggcgattgccattcccttcctcgtctacctcgccctgcaaattgatattcggtaaaacacaagtcccctttgttcaactgtaaaatgttttccatgagatactgattagttgaattgataatagggtgataataaatcttataaggacttaattctgtttccaaataagatagatttaataaaggaagttgcggttttaaagaaatattttgctcattatcaacaatacaaattccttgttgtcttaattgtgctatctgcttttccagttgtactcttgtcaggtctaaaagtgcggttaaatttttgtaagaatagggtttgcatctagctaaaatagataacaacttaatcatttttccctcgctatcaccattataaaatctcaagcagcagtacttttaacacaaattttttcaagagaaaatattataaaaaaacattttcaaacaagtatgagatctgtataatcccgacgcaatattttttatcctttttaatcttaatagagagaatattgcactatgttacgcatcaaacaagaagctttaacttttgacgacgttctattagttccggctcattctacagtacttcctaatactgctaacctttcaactaaccttaccaaagaaatccgtctaaatattcctatgttatctgctgcaatggatactgttaccgaagctaaattggctatttctctagctcaagaaggcggtatcggatttattcataaaaatatgaccattgaacgtcaagcggatcgtgtgcgtaaagtaaaaaaattcgaaagtggaattgtatctgaaccggttaccgtttcgccaacaatgacgttaactgaattagcggaattggctaagaaaaacgggtttgcaggttatcctgtagttgatgaacaaaaagggttggtagggatcattacagggcgtgatacacgtttcgtttcagacttgaataaaactgttgcggattttatgaccccaaaagatcgtttagttactgtgaaagaaggggctactcgagaagaaattttccatttaatgcacgaacatcgtgttgaaaaagtgctggtagtggataacagctttaaactaaaaggcatgatcaccttaaaagactaccaaaaagccgaaagtaagccgaatgcgtgtaaagatgaatttggtcgtttacgtgtcggtgccgcagtcggtgccggtcccggtaatgaagaacggattgatgcgttagtgaaagcaggagtagatgttttgttaatcgactcatctcacggacattccgaaggcgtgttgcaacgggtacgtgaaactcgtgctaaatatccaaatttacctattattgcagggaatattgcaacagcggaaggtgcgattgcattagctgatgcaggggcaagtgcggttaaagttgggattggaccgggatcaatttgtacgactcgtattgtaacaggtgtgggagtgccacaaattacggcgattgctgatgctgctgaagcattgcgtgagcgtggtattccagtgattgccgatggtggtatccgctattcgggtgacatcgctaaagcgattgcagcaggtgcatcttgtgttatggtcggatcaatgtttgcaggaacggaagaagcaccgggtgaaatcgaactttatcaagggcgagcatttaaatcttaccgaggtatgggttcccttggtgcaatgtcaaaaggatcttccgatcgttattttcaatccgataatgctgcggataagctagtgcctgaagggattgaagggcgtattccatacaaaggcttattaaaagaaattatccaccaacaaatgggtggattacgttcttgcatgggcttaaccggctgtgcgactatcgaagaattacgcactaaagcccaatttgtacgtatcagcggagcaggcatcaaagagagtcacgttcacgatgtgaccattaccaaagaagcaccgaattatcgaatgggctgatataacaaacggttggtttttgcaaaatttgcagaatttgtgtcgcttgtactgagataaggagcataaaatgaaaaaattaggtttgatttctatactgttattgtccggctgtggcatttttggtccatcatattcagggcaaacaacagcagactggttattaaaatcagatacagaaagcactattaggctatattttcgtgctataaataattgtggaatagaaaaaatccatacggaaatcaattcaataccgagtgcaggtaatgtaaatgaaacttggactgtaacaggctgtaatataacaaacgtttttaatgtgaaatatgttagtgacggtcatggcgggacttactttcgcgtatctaaaaaataaactaaaactttaggaaacaaaatgacaaatatccatcaccataaaatcctcattttagatttcggttcacaatatacgcaacttatcgcacgtcgtgtacgtgaaatcggggtgtattgcgagctttgggcttgggacgttacggaagaacaaattcgtgagtttaacccaacaggaattattctttcaggcggaccggaaagtacgactgaagcgaatagtccacgtgcaactgaatacgttttcaatgcaggtgtacctgttttaggtatttgctacggcatgcaaaccatggcaatgcagttgggcggtttaacagaaacttctacgcatcgtgagtttggctatgctgaagtttctctacaaaatccgaccgcactttttgcagatttaaacgatgatctgaccgcttgcgatccaaaattggacgtttggatgagccacggcgataaagtgactcgcctacctgataatttccaaattacaggcatgacctcgacttgcccgatcgcggctatgtcagatgaaagccgtcgtttctatggcgtgcaattccaccccgaagttacccacacaaagtgcggtcaaaaattactgcaaaattttgtggtagatatttgcggttgcgaaaccaattggaccgcagaaaatatcatcgaagatgcagtggctcgcattaaagcacaagtgggcgatgatgaagtaattttaggcttgtcaggtggcgtggattcatctgttaccgcacttttattgcatcgtgccatcggtaaaaatttacattgtgtctttgtcgataacggcttactccgtctaaatgaaggcgatcaggtcatggaaatgttcggtgataaattcggcttgaatattattcgagtagaagcagaagatcgctttttagaagcattaaaaggaattgatgaaccggaagcaaaacgcaaaactatcggtaaagtattcgttgatgtattcgatgatgaagcaaaaaaattaactgacgtaaaatggttagctcaaggaacgatttaccctgatgttatcgaatcggcagcaagcaaaaccggaaaagcccacgttatcaaatctcaccacaatgtaggaggcttacccgattatatgaaattaggtttagttgagccattacgtgaactcttcaaagatgaagtgcgtaaaatcggcttggcacttggcttgcctgcagaaatgcttaatcgccacccattcccaggccctggattaggtgtacgtgtactgggtgaaatcaaaaaagaatattgcgatttactgcgtaaagccgatgcaatttttatcgaagaactgcataaagcagattggtactacaaagtcagccaagcgttcagtgtcttcttgccggtaaaatctgttggggtaatgggcgacggtcgtaaatatgattgggttattagcctaagagcggtcgaaaccattgactttatgaccgcacattgggcaaacctaccttatgatttattaggcaaaatctcaaatcgcattatcaacgaagtcaacggcatctcccgtgtagtttatgacatctcaggaaaaccaccagcaacgattgagtgggagtagctaaaaatctaaagccttataaatagacattttgtgagtgttgtgcttgcaataaatcacctgaaggataattcttcgggtgattatactattaattcagggactgtattagattagccctaaatgacacacattttcgtagtgtttttaactgctctttagatattccaaagacttacattccttcaaaaataaaggagagtttattcggtcaattccattgtattttcagagtattcgtttggcttagcccccaaattttctatgtcgttgatgtagtcttgtttgactgcccccgaaatgattaattctttcgtggtgaaattcacttacatcaagggctaaatgataacggattagctcatggatgtttcgataaaacaatgcacttgaattttgatttatacctaaaatatctgctgcggatcgtgctgttacttctagcacaaaaaattcaaggagctttttctgtatagatttctttaatttacaatgagttgtcttcatttttatagactagcatacttgctaatctaatacagcccctttttttatattgatgagtttgatagatagacactatcctaaaaaatcacaaaggcagcttaattctacaggtgataagattggaaatcggaagcttggtagagaagcaatttaaaagatatatcaatatcataattgcccgaattttcgctaaaaacgtaatatcgggcaaattatatggcattgtaaagagaataaatgtgaagcagttcacattctatacacaaattattgctgtatgatgaaataatttgttttattttatatgagaattgaaaatatatttcaaacttgtttcgtaatatataaagaggagtttgttatatgaatagtaaatttaccccccccctctccatttccacgcctgttgggaatctattaaacagcatcaagttcctgaatggtatgaagatgctaaattcgggatttttattcactggggaatttattccgtccccgcgtttgcaccaccgacttgtcaattaggtgagatcgatattgacgagcaatggttctgtaacaatccatatgccgagtggtatttcaattcaattaacgtcaaaaaaggtccgacttacgagcatcatatcaaaacctatggtgaagatttcagctatgaacagtttattccacaatggaaagcggagaagtggcaacctgccgaatgggcggagctgtttgccaaagcaggtgcaaaatatgtggtgctgaccaccaaacatcatgacggtttctgcttatatccaagtaaatataccgatttcaactgcactgaagctggtccacaacgtgatttgatgggcgagctgactgataatgtgcgtgaaaaagggctgaaaatgggagcttactactctggtattatagactggacctactcttctgcaccgattttcaccgagagtcaaaacttttccaatgcttgcccaacctatgaatacgccgattacgcttataaacaagtggttgagctgattgataaatataaacctgatgtactttggaatgacatcggctggccgaaagccggtgaacatatgcttccgcacttgtttgctcactactataacagcgtgccacacggtgtggttgatgaccgttggaacaagctctggtgcgatttcacctcaaaagagtacaaacacggcgtggcttcgcgtgataaaaaatgggaaatgtgccgtggtatgggcttatcatttggttacaacaaagtggaagatgaaagccacttgatttcagtgaaagatctgatttcgctcttagtagaaaccgtggcagacaacggtaacctgttgctcaacatcggcccaaaagcagacggtactattccacaagagcaagttgaacgcctactctccttgggtaaatggttggagcaaaacggtgaagggatttatcgctcccgttgcagtaaatattcccccgaaactgtaaacggtgtaacaatgattgcccgccctcagatcgaccaaaatcgcacgtcttaatcgttccgagtgctgtatcgttacaacaaacagcggctgtttaaggaatccatcagcagcgtgggcgtgttgaaaactgtttgcattccttaaaaaaatacatataacaataatttttatttgcatattttatataatataagaaaggatataggtaaatgacctctttcaaattattaggcttttcggtcttgagtgtggctttgctctctgcctgctcttccggcaaaggtggctttgatttagacgacgtcgagcatacccccccctcctcctcgggtagttcccgccccacttatcaagatgttccgactggacaacggcagcaagaaatagtagaagaaatcaactcacctgctctaggttatgcgacagaaattccgcgtaggaatatttcgccaatgcccaccacgggcacaaaagaaagtaatgctcgtgttgccattactgcccagcaagttgcccctcttagcatgccttttaattcaataaaagaagattttatcaaaaggctaatagcagaaaacaccaagaaaaatgcacgaggtagagatgtaaaatattttgatgatacagatgacgtgttgtttgcacatgatggatctaatttagcgcataaacgtgatttacaatatgttcgagttgggtatgtgttgggtacccgaaagattgaacttgttttttcccatgataaaaaaacaagagatcaatttcctgctggttgggtaggttatgttttttaccaaggcactagccctgcggttacattacctacacaaaccgtaacatacaaaggctattgggattttgttagtgatgccttcaatgaacgaactttagctgaagattttacacaggaaaatagttctgctactagcaatataccgggcaatcaaatcggtgcgacttcaatggatgcattggttaatcgcaaagtttcaggagaaaaaatcaatattgctcacagtgctgagtttactgctgattttggcagtaaaaaactttcaggtgaattaaaaagtaacggttatgtttctagaatagaaaatgagcaacaagatgtaaaaacacgctacaaaattgatgctgatatcaaaggcaaccgttttgtcggttcagcaacagcacaagaaaaaagtcacaccatcttcggcaaggatgcggacaaacgtctcgagggcggtttctttggtcctaaagccgaggaactggcaggtaaatttctgaccgatgataattccctgtttgtcgtctttggtgcaaaacgtgaaagtaaaggcgatgaaaaactagaaacccgctttgatgccgttaaaatcagcacggatagtaataaattagaaaaagaaacgatggatacgttcggcaatgcggcgtatttagtgttggacggcagacagtttcctttggtgccggaaagtaatgccggtacgacgggcgctggcaacacaggcaagaatgagtttatcagcaccatagacggtagccatttaaacaaaacaaatcatgaaaaccacaaaaaatacaaagttaccgtatgttgcagtaatttggtgtatgtgaaattcggcagctatggggaacaaacaacagcaaacgatgcttcaaacagcactgccggtgcagcaactacgcataacagcacattaacaaacggacaccttttcctaacaggtgaacgtacttcgcttactgatatggcgaagcaaagtggtgcagcaaagtatattggcacatggcaagccaactttttaagtagcaaaggacaggttggcagtgttgacgccggtgatccgcgtaacgatagtggtaaaagccgtgctgaatttgatgttaattttggtggtaagacagttacaggcaagttttttgatgccgacggtattcaacccgccctcacaatggatagtaccaagattgaaggtaacggcttctcgggtacagctaagacaactggtagtttgcaattagataaaggcagtacaggtgcgggtataacagtaaccttcaccgatgctaaagtcgatggcgcattctacggtccgaatgcagaagaaatcggcggtaccatcacatcgaatggcacgggcgataaagtcggtggggtgttcggtgcgaaacgccaagaactatcgcaacagaaatgaaatcttaactctagctacctgaaacatatttcaggtagcaggatgggtatctgctgatatgctcaacctgcttgaaaaagtttgtcaaatccgccgcctgtcgttgttgacggtgtgatgttgcagtggcaaatcgctcggctttgttgagaaagcatgacccatccgtcttttactcacacggaacgaaaaaaatgtctacaaaacctttgtttaaacttaagctgataacattggctgtcagcacgatttttttaccttttactgaggcggttgccgatactgaatcaccgagtagcaatacagaagcagtgctggagttagaagctatccaggtgcaagccaaacacgagatcagcagacatgacaatgaagtcaccggtttgggtaaggtggtcaaaagcagtgaagacattgataaagaactgattttgaatattcgcgatttgacccgttatgatcccggtatttcggtggtggagcagggacgtggtgcaacgtcaggctatgcaatgcgtggtgttgacagaaaccgcgtggctatgttggtggacggcttgggacaggcgcagtcctattctaccttgaaatccgatgccaacggcggggcgattaatgaaattgaatatgagaatattaaatcaattgaattgagcaaggggtccagttcggcagaatacggtagcggtgccttgggcggtgcggtagggtttcgtaccaaagaagctgatgatgtgattaaagaggggcaaaactggggcttgaacagtaaaacggcttacagcagcaaaaacagccagtttacccaatccgttgccggtgcgttccgtgtcggcggttttgacagtttggcgatttttacccatcgtaaaggtaaggaaacccgcgtgcatcctgctgccgaagaaatacaacatacttaccaaccattggaagggtattttaatcggtatgaggttgaccaaagcaacggaaagcctgttctggcgaatgcgtattatatacttgccgatgaatgctctaatctaagtgatccgagttgtcgtcatgccaaggccaagacgaatagggtgggtgccccggagaacaatcctaattggacgcccgaagagcaggcacaggctgctaaaatgccgtatccgacacgtaccgcctctgccaaagattatacgggtcctgaccgcatcagccctaatccgatggactaccaaagtcactctttcttctggaaaggtggttaccgcttgtcgcctaaccattatgtcggcggggtgttggaacatacgaagcagcgttacgatatccgtgatatgacgcaacgggcgtattacacgaaagaggatatctgccacagcggatccagttgccaaacgttggataaaaatgagacggacaaaggtaatttcggtatcacgttgactgataatcctttggacggtttggtatatgatgccggcaatcaagctcgtggcgtgcggtacggacggggtaaattttttgatgaacgccatacgaaaaatcgctcgggtattttttaccgctatgagaatcccgataaaaattcttgggcagatagcttgaccttgagtattgaccgccaagatctcaaactgtcgagccgtatccattggacgtattgcaccgattatcctcatgtggcacgttgccgtgccagcttggacaaaccttggtctaattaccgtaccgagaaaaacgattatcaagaacgactcaatctgggacaattcaattgggaaaaaacttttaatctgggctttaccacgcataaggtgaatatcgccgccggctttggtacacatcgctccaccttacaacatggcgacttatatgctgaatatgtcaccttgccaccgtatgaggaaataaaagtgtatgaagataaaggtgcctttaaaacagatacgacagcagaggagaaattacaatacggcaatggttcttatgacaaacctcgcgtatatagacgtaaaaacacgccggaattaaaaactgtcaatgggtgcaatgagacagcaggcgataaccgtgactgctcgccacgtgtgattacgggcagacagtattaccttgccttgcgtaaccatattgcctttggtgaatgggcagacttggggttgggcgtgcggtacgacaaccataccttccgctcgaatgacccgtggaccaaaggtggcaactaccacaactggtcgtggaatgcgggcgtgagcctcaaaccaacccgccactttgtcgtgtcttaccgtgtgtccagcggtttccgtgtccccgctttttatgagctgtacggcgtgcgtacgggggcttctggtaaagacaatccactcacacaaaaagagttcttgagccgtaaaccgttgaaaagcgaaaaagcctttaaccaagaaattggtttggccgttcagggagattttggtgtgatagagaccagtttcttccaaaacaactataaaaacctgcttgcccgtgcagataaacatgtcgagggattgggttatgtaaccgatttttacaacacccaagatgtcaaactcaacggtatcaatatcttgggtagaatctactgggcaggcatcagcgataggctgcctgaaggcttgtattccacacttgcttacaaccgtatcaatatcaaagcacgcaaattgcacgacaattttaccaatgtgtctgagccgacattggaagccgtgcaaccgggacgtattattgcaagtatcggctatgatgaccctgagggcagatggggccttaatttaagcggcacctactctcaagccaaacaacgtgacgaagtggtcggcgaaaaagtgttcggcaagggtggcagcattaaacggacgatcaacagcaaacgcactcgcgcttggtatatttatgatttgacggcatactacacttggaaagaaaaattcacgttgagagccggtatctataatttaaccaatcgtaaatatagtacatgggaaagtgtgcgtcagtccgctgccaatgcggtcaatcaagacctaggtacacgttcagcacgttttgccgcaccgggcagaaactttaccgtgagtatggaaatgaagttttaattaaaaaactgtctgcaagctgtttaaaaaacagttgagatgatttgttcgtataaatagctgcttgaagtcttgttatgcaggttcaggcagcttgacattccaaaaaaaggaaaaaagtctaatggaagacaatatgctatttgtcggcaacgaaattaggcaacgaaaaattgttgcaatggattagcagttcaagtggcttccggtattttttatcgcactttttctatctataagcttgaaatctttatttccgaacttatattttcgctgtttgttaatttcactattggaaaaggaaatattatgtcaacaaatcaagaaactcgtggttttcagtctgaagttaaacagcttttacaattgatgattcattctctttattcaaataaagagatttttttgcgtgagttgatttccaatgcgtctgatgcggcggataaattgcgttttaaagccttgtctgcacctgaattatatgaaggagatggtgatttaaaagtgcggatcagttttgacgcagaaaaaggtacgttaaccattagcgataatggtattggtatgacgagagagcaggtgatagatcatttaggcactatcgctaagtccggaacaaaagaatttttggccgcacttggacaggaacaggctaaagatagtcagttgatcggacaattcggtgtcggcttttattcggcatttattgtggcggataaagtaacagtgaaaacgagagcagcaggtgagccgatagatagagcggtgttgtgggaatcagccggtgagggtgaatattctgttgctgatattgagaaaagagaacgtggtacggaaattactttgcacttacgtgaagaggaaaaagagtttgctaatgaatggcgtgtacgtgaaattatcggtaaatattctgatcatattggcttgcctgttgaaattttagcgaaagaatatgatgaagaaggtaaagaaacgggaattaaatgggaaaaaattaataaagctcaagcactttggacaagatcgaaaggtgagatttctgatgaggaatataaagagttttataaacatttaagccatgattttgctgatcctcttttatggacacataataaagttgaaggaaatcaagaatataccagcttgctttatgtgccgtctaaagccccttgggatttattcaatcgtgagcataaacatggtttgaaactttatgtacagcgtgtatttattatggatgatgctgaacaatttatgccgaattatttacgctttatgcgtggcttaattgatagcaatgatttgccgctaaatgtatctcgtgagattttacaagataataaagtgacagctgctttacgtaaagcattgaccaaacgctcattgcaaatgctggaaaaattagccaaagatgacgaggagaaatatttacaattctggaaagaatttggtttggttttgaaagaaggtccatcagaagactttgcgaataaagaaaatattgccaaattattgcgtttcgcttccagtaaaaatgatagctcagaacaaaccgtttctttggaagattatgttgctcgtatgaaagaggggcaaaaggcaatctattacatcactgcagatagttatattgctgctaaaaactcaccgcacttagagctgttcaataagaaagatattgaagtattgttgttgtctgatcgaattgatgaatggatgttaagttatttaactgaatttgacggtaagcaattacaaccgattactaaagcggatttggatttaggcgatttggcggacaaggaacaagaagagcaaaaagagcaggataaaacctttagttcgtttattgaacgagtaaaaaccttgttgggagaacgagtaaaagatgtgcgtttaacgcatcgtttaacggataccccagcagtggtttctactgataatgatcaaatgaccacgcaaatggcaaaattatttgctgcggctggacaacctgttcctgaagtaaaatatacgtttgaacttaatcctgaacatcatttagtgaaaaaagtagcagatttggctgatgaagacgaatttgcaaattggattgaattactgcttgagcaagcgatgcttgctgaacgtggttcattagaaaatcctaccgcatttattaagcgagtaaacaatttattggggtaatggttgtttcttagctgattgatgtaataaaactctctaatttattagggagtttttttatctatgtttgacacttgtagtaaaaaagtgcggtagtaaaatagcatttgaatagttaaaaaaatgctaacaatggaattttcacgtataattcgaagtcgggttttattgactttttattgaaggattgttgatgaaaaaaattatcttctttggaactgttatttggttaactgcttgtaccacaaccaatttatcatcaagttgccagcgttattttagtatactggaaaaaaatatggcacaattttccctatcaagttctgaactagccaagtttaaacaaaataaaaataaattaagtcaattgccggaaaaagaacaaaataaaatttgccttttaagaatggcaaatattcaacagtatagaaattgattgtttctgatgtgttcaagtttttttatggaataaatatgactacgttcgtcgcttggggcaatattcaacaatattatccttttgaaacaatacctttgcggttgctaaataaaaacctaacgcattcagcaagtaactataaacctgtgcagcaacgttatcattgtcgccgtttagcacattttttattgtggcaattgttacaaaaagctggtgttaataccgcacttttaggtgatattaagcgttctccatccaatcgtccttactttctacaagacaatattgattttaatatcagtcattctgatgattgggtagcagttgttttacaagttgatgaaaataatgataaaagtgcagtaggaattgatattgagtttgccaaaaaaacaagaaattacgccgcacttttacagcattttgccagacggcaagaggtgatttggtttcaacaaaagccttgtgaggaacgtttttatcaaatttggtgcggacgagaggcgttattgaaatcgcagggcgtaggtattgtcaaattatcggaagtcaaccatgtgccggagaaattattactttattccgattattgcccaacgggaaagcttatatttacggcggagttgcctttttattttgctcttttttgtcatcaacatattgaacaaacacaatattttatgtggcaagataaccggtttgtttcaaaaaaactgacgcagacaattgaatatcaagtgaatcctttaaagcagttcattcaaatttaaagtcggttttcgttgcataatgaaaatgaggtagagtattgctcaaattgaatttacgaagattaaattatcaaaggacaacagagtcatcgtgaaattgcggtagaaattcaggactttttaagtggtaacaaaaagcctcatcaataaaaatgaattgataaggctagaaaatttggtggagataatcgggatcgaaccgacgacctcttgaatgccattcaagcgctctcccaactgagctatatccccgtaaatcgaatgtggcggctatgataaattccgccacttgtgctgtcaatatagaatattaaatattttttttactagattaaatattaaacattttgtgtatgaataaacgcaattgcattatttattctgctaattgtgcgatctttaccaaccaatttcgctgtaatatccattgacggtgattgtcccaaaccagttactgccaatctaaatggcattcctactttacccataccgatatcaagctcttgggcggtttggctcattacttcatgaatattttcaactgtccagtctgaaagtgcggtgagtttttctgccaatttagctaacggtttaatcgcttcaggcttgaagtttttagcaacagctttttcatcatagttttcaacatcttggtagaaataacgacttgagatggctaactcttttaatgttttgcaacgttcgcttaaaacgggaataatttcagctaagttcggaccattgctataatctatgccgtgttttttcatatgccattctagatgggttgcgacctgctctaccggcagagaacgtatataatgctggtttagccattgtagtttttcagtattgaatgcacttgctgatttgctaactgaatgaatatcgaaaagtgctatcatttcttctcgactaaaaatttcttgatcaccatgtccccatcctagacgaacaagataattgattagtgcttcgggtaaataaccttcatctcgatattgcataacacttaccgcaccatgacgcttagataatttttgaccatcatcaccattaatcatagatacatgagcgtaagtcggaattggtgctcccaatgctttaagaatattaatttgacgaggcgtgttattgatgtgatcttcaccacggacaacatgcgtaattcccatatcccaatcatcgacaacgacacagaaattataggttggcgaaccgtctgtgcgacggataattaaatcatctaattcacgattgctaatttcaatacgcccacgaacggcatcatcgaaaacaactgtaccttccgtcggatttttaaaacggacaacgtgaggtgcatcaactggatattcactttgatgtaagcagtagcgatcatagcgaggtttttgtttattttgctcttgactatgacgtaggtcttccaaacgttctttagtacaataacaacgataagccaatccttgctcaatcatctgatcgattacttggttatagcgttcaaaacgttttgtttgaaaatacggtccatgttcccacgctaaattaagccattccattccctctagaattgccgctgttgcttcaggggttgaacgttctaaatccgtatcttcaatgcgtaatacaaattctccttgattatgcttggcatacaaccaagaataaagtgcggttcttgcaccgccaacatgtagatagcctgttggacttggtgcaaaacgtgtacgaactttagtattgggatctaaattaaaaagtggttctaatttcattcattttgcctttatttaatcaatcataaaacggtgcttattgtacaatgagttatttaatttcataagaaaaaattaaaattatgtttatttttaagacagttaaatagaaatccataaaaaatcattgactgttttttgataattcttataatgcacctcgcacaatacaagggcgattagctcagttgggagagcacctcccttacaaggagggggtcactggttcgagaccggtatcgcccaccactattctatagtgaactttgtattgtaatattggcttaaggggcgattagctcagttgggagagcacctcccttacaaggagggggtcactggttcgagaccggtatcgcccaccactttagccggatttcccatttgactttaagtcaaatccgatagctgaaaagcgattcgattctatcgggcgattagctcagttgggagagcacctcccttacaaggagggggtcactggttcgagaccggtatcgcccaccaattcaaaaaatctaaatttttccacgttgttaaacttattacaactttcgggttgttgtcttttttatctatatttttaactaattattgttcacttttgcgatcttgatcgtaaaactacgatacttgcaaaaaagttttttcctgattccattaaaattattttttatttaacgaataggaaaacatatgcagaatttgaagctattttcttggaaagccactaattttttacagcaaaaacaagctggaatgcttgttatcgaaaatgtacaagaggccaaacgctatttattacaacaagggctaaacaatatatatttacagcgtcattggcaactgaataaaaagcctaaaaaaatagaattttgtgatctattaactcaattagcaatgttattacaatcctcaattcctttaaaagatagcttacaaattttattgagaaattgtgttaatatttctttaaatcaatgggttagatatattttaaaaaatcttgaaggaggattatctttttcacaatctgtggctcaatcaggtctatatttttcttatcaagaacgccaactcatttctgttggagaaatgacgggagatttagcctctgtttgccaacaaatagcagaacatcgtcagcaggcattagcattacaacgcaaaattcaaaaaattttactctatccaatgatagttttaagtatttctatcattctcaccgcacttctattaatttttatcgtgccacaatttgccgaaatgtacggttctaatcaatccgagcttcctttttttacgcaactattgttaaacatatcctcttttttacaacagtatttttttcatatgatagcggtatctattttatttttttatctaataaaattacgtttacacaattcatatagttttcaactcaaaaaagattggtttttatcgcatgtgccgttgttaaataaaattattcggcttaatagaacgataagtttttgccgtagtttaggattaatgctcaactcaggcattcctttacaacaaagtctatattctttccttccccaaaactctatcaacatacagaaaaagattgagggagatctcacgttaattaatgaagtaaagctaacattacgtggtatcgaacaaggatataaattctctcagtctgtaagcagtaatttgttttctatacaaacacaaccaatgctacaagttggtgaaaagagtggaaatctaggtttaattctgcaacatatcgcagaaaatcagcaacaacagttagatcatcaaattgatttactttcacaaatgttagaaccgtttatgatggtgatcattggcggattaataggtttgattatgttaggtatgtatttaccaatctttaatatgggaagtttaattcaatgatttatctggcttatatgttgtttggtgggctttgtggcttatgggtttacctttatgtcaggcaattttctgctcagattaataaacaagtttactcgactttttgcgaaattttccccgaaaatgcaccgcacttgatgcctatgtctatcttacgacggaaaaagtgcggtcatttttctatgtattttttgtgtggtggcctttggtgtaatatatgtttaaatttcccacaaaatatttatgttggtttatggttagcatgttgcggttatttaattttttgccttgttttagtggattggctataccaactcgtttcacaaaccttatgccaagccctatttattttagggttattgggtgcttatcaaggtattagcccattgactttggagcagtctttaattggtagcttatcaggtttttcggttttttatcttatttacattgttgcaaaattattctatcgttatgaagctttaggacgtggcgattactggttaatgttagggttagggagctttatatcttggacaaaattaccgttgctcatttttcttgcctgcctcacaggattaatatatgtcgtttttaatacaagagacaaaaaaacaatatttattccttttgccccattcttatgtctctcaaccattatcgtatacttgcttaattttctaagggaggatattcttccttaaattttagggaaagaagaatatggcttatattgtagggttaaccggtggtatcggtagcggcaaaagtaccattgcgaatcttttttcagaactaggcgtacctattgtggatgccgatgttgtcgctcgagatgttgtagcaaaagattccttaatcttagagaaaattattgctcattttggtgaagaagtgcggttggaaaatggtgagttaaaccgatctgaattgcgtaaattggtatttcaaaatgaaaaagaaaaattatggctaaataatttgttgcatccggtaattagagaaaaaatgctgcaacaattacgctctgttaattatccttatgtgctttgggtcgttcctttactcattgagaataagctaatgaaattatgcgatagagtactggtaattgatgtagagcctgaactccagattttacgagcaagccggcgggatagtaattcggttgaattaattaaacaaatgatacagtcgcaagtaaatcgtgagttacgtttaagttttgctgatgatgtcattgaaaataatctaccccttgaaaaaaacgtggctaatttaaaacaaagcgtagcaaaattgcaccgcacttatttgcattatgcgaagataatttctagaaatagtgaagaatttgaggatataaaatgattgatgaaaaatttactgtagcctgtcccaattgcaaaaaagaagtactttggtcagaggaaaatcgatttcgtccattctgtagcaaacgttgtcaattaatcgacttaggtgaatgggctacagaagaaaagattattcccggttcagaaataaccttgttaccgaaagatgaatttaaagaaaattgagagttatgaatggatagataaataaatagataaaaagaatattgagattttaatttgggcttgttagaatcagcccacttttattttgataaataaaaatatagttcgaatgaaggtagctggagaatggggaattgaccccaaaccgacgaggtaaaatctttcaggtgcgatggcgaggactgttactggacgaacccttggagagatccaatgtgcaatgcacaaaatggacgccgaaggcgcaaaagagcggtgttttttactgcttttcaaacgctcaggcaaaaggacaggggcaaaagattcttttcggatagaaacgttgcatagcgttttttctttattatcccaaaaacttttcgcctccttgtaaacacacgttattttacgaggaatacttatgtcattagagataattttatcgtctatcaatacttttgtttggggacctcccttacttcttcttttatttggtacaggtctttacttgaccttacgcttaggatttattcaaattcgttacttacctcgtgcattatattatttatttgataaagaacgtcatgtaagtaaaaaaggggatatttctgctttcgcagccctttgtacggctttagcggcaacaataggtacgggaaatattgttggtgttgcaactgctttgcaagccggtgggccaggggctattttttggatgtggttagttgctttacttggaatggcaactaaatatgctgagtgtttattagcggtgaaatatcgggtgcgagataaacaaggttttatgagtggcggaccaatgtattatattgagaaaggcttaggaataaaatggcttgccaaattttttgccgtctgtggtgtattagttgcatttttgggcattggcacttttcctcaaattaatgcaatcacgcatgctatgcaagatacctttaacgtatctattgaaattacagcaaccattattaccgcacttattgcacttattatcttaggcggtgttaaacgcatttcaacagttgcatctattatcgttccttttatggctgttttatatgtacttacgtctttgttaattcttatactaaattggcaacaagtaccaaccgctattggactaattatttacagtgcatttgatcctcaagcagcattaggcggtgtatttggatatactgttctgaaagctattcaatcaggatttgcaaggggtattttctctaatgaatccggattaggtagtgcaccaattgcggcggcagcagctcaaactaaagaacctgttcgtcaaggattaatttcgatgataggtacttttttagatactatcgttgtatgtactatgacaggtatcgtgcttgttttaacaggtgcttggcaatcacaagaattggctggtgccgctttaactaactatgcattttcacaagggttaggaaataatattggtgcaacaattgtaactgtagggttactgttttttgcttttaccactattttaggttggtgttattacggagaacgttgttttgtttatctggcaggtgtcaaaggtatcaaagtttatcgttcaatttttatacttttagttgcctgtggtgcttttattaaactggaattaatttggattttggctgatattgtgaatggtttaatggcatttccaaatttaattgctttagttggattgcgacatattgtgatcaatgaaactaaagattattttattcgcaggaaacaaatatttgttgagccaaataatgtagctaattgagcaaaaattaaaggggctgacgtcccctttaaatttctctacatcagaccatcatatcaacctcaaataaaaataaaagtgattttttataaatatgataagtagatcatactttttcatttttattcctaaaaagtgaaaaaacaccttgaaaactcctgctaagaggactattttgtaactaagaatttttctgagtggaaacgctcatcaataagcaaaagaggtaaaagctatgactctaaatatcacaagtaaacaaatggaaatcacccctgcaatccgttcacatatagaggaaagacttgctaaattaggaaaatggcaaactcaattgattaatccgcattttattttaaataaagtaccgcagggttttgctgttgaagttgccataggtacgccttatggcgatttatttgcaagtagcgagtctgatgatatgtacaaagcaattaacgaagttgaagaaaaattagaaagacaattgaataaattacaacataaaggagaagctcgccgagctagtgaaagactaaaagacttgttttgataaatgagtttgtctaaaagtagagtgaaaataaaacgctctatttattgcgtaatgaattttacttattgtatgttacctatttgaacctaccaaataagtagtgtaaatcgtggcttctcgtaagtcctaaaaaagctgatgtttaaacttcagcttttttgttagaatatatcggcgataaattttattaaggaatgaagatgaaaaaacatcatgttgacgttttaattactgaggaagatgtacgttcacgtattcaagaattaggtagagaaattacacaattctatcagcataaacacgtaaataaattggtagttgttggattattacgtggttcatttatgtttatggctgatttagtaagagaaattaaattaccgattgaaattgaatttatgactacttccagttatgggaatgaaatgacaactaatcatgatgtacgaatagctaaagatttagatggcgatattaaaaatgaagatgtattgattgttgaggatattattgatacaggatataccttagaaaaagtgcgggagattttattgctacgttcgcctaattcattagcaatttgtactctattagataagccatctcgccgagaggtagacgttcctgttgaatgggttggatttactattcctgatgaatttgttgtcggctatggtattgattatgctcaatgttatcgtaatttaggctatatcggtaaagttactttggaagaataagttaccgaaaaggaaatgtttctatcaaaaattaaacaaaaaaagagattaaaaaatctctttttttacacattctttaagaaaaaataactatatagataaaattgaaaataattagaaattatcttcaagcattgttaacttttttctcaaagcgttcagcagcagcatcccaattcaccacattccaaaatgccttgatataatctggacgacgattttggaattttaagtagtaagcatgttcccaaacatccaataccaaaatagggaaaccttcgcaaccggcaatttcttttcccattaatggactatcttggtttgcggtagaaacaacttctaatttgccttgatttaatactagccaagcccaaccggaaccaaagcgagttgcagcggctttctcaaactcagcttggaaactctctactgaaccaaaatcacgctcaatagcgtcttttaatgggccttgtaaagttgtacctgtttttaaacctttccaaaataaactgtgatttacatgcccaccaacattattgcgaatagcagtacgtttatcagcaggaacttcgactaatttggtaattaattgacccggacaaagatctgtaaactcaggtaaagtttctagtgctgcatttgcattattaacgtaagtttgatggtgtttactatgatggagttccatagtttgtgcatcaaagtgcggttctaaagcatcataagcataacctaattcaggtaaagtataagccataacaatttccttctataaaaaattctgaataataaactcggcgaattctagcaaaaaatttgatcaagatcattaaaagtttaatttttttaaaaagccctaccgtaagatagggctataatagattaaaaaacattcaacgattctgtgcttttaccgctgcaacggctaccatattaataatacggcgtactgatgaagcagaagtaagaatatgtgccggtttttccacacccattaaaattggtccaattgtaattggtgttgctgtaccttgtaataaattcaagctaatacgggcagtttccatgttgggcataatcaataagtttgccgcccctttaataggactgtcaggcatcacttccttacgtaaattctccgataaagcaatatcacagtgcatttcaccatcaataatcaaatccggtgctttttcacgcacaagctctaaaacctgccgcattttaactgcacttgggtcattaattgagccataatttgaatgtgaaacaagagcaacctgtggctctataccaaaacgacgaacttctttggctgacataatcgtgatttctgcaagttcctcggctgttgggcttgagttcacaaaagtatctgcaataaataaattaccggtaggcaaaaccagtccgtttaccgtagctggaatttcatgttctttttcaccaacaacctctttaacagtagccaagtgtgccgcaaatggtccaactaatccgcaaatcatcgcatcgactttaccaagttccaataaaactgcaccaagtgcggtcggattatggagcatttttcgtttggctccggtaggcgtcataccttggcgttttaatttgttgtaataagtatcacagcattcctcgtagtatgggttattttcaatgtcaataatctcaaaatcacgtccaacctgtaattgcagccctaattttttgatgctttcttcaataatatgagtacgccctaacagaacaggatacgctatgcctaaggttgcaatttcttggattgcatgtaatacacgtttttcttcgccatcagttaaaataactcgctttttatcttctttggcctgtgcaaaaacaggtttcatgaataagttggttttataaacaaactgggttaatttctcaatatatgcctcaaaatcttcaatcggacgagtagcaacaccgctatccattgcagctttagctacagctggtgcaattttgacaattaaacgaggatcaaaaggttttggaataatgtaatcaggtccaaaggaaacaccgctctcaccataagcagaactgacgacttcactttgctctgctaacgctaaatcagcaatagcataaactgccgcaagtttcatttcctcattaatagtggttgcactgacatctaaggcaccacggaaaatgaacggaaagcataatacattatttacttggttcggatagtcggaacgaccagtacaaacaatcgcatcaggtcgaacagctttggctaacggtggtaaaatttcaggctcaggatttgctaaggctaaaattaaaggattaggccccattgtttttaccatttcttgagtaagtgctccagcggcagaacaacctaagaaaatatctgaatctggaatggcatcagctaaagagcgttgaccgttatcatcaatagcatataactttttggtgtcatccattttttcgtcacgacctttataaatgacccctttagagtcacaaaccgtgatattttcacgtttcatgcctaatgaaaccaataaatttaagcacgcaatcgatgctgcacctgcaccggaggcaactaaacgaacatcttcaatttttttattaacaatacgcaatccgttaattattgcagcggctgaaataatggctgttccatgctgatcatcatgaaaaacaggaattttcatacgttcacgtaatttctgctcaatataaaagcattccggtgctttaatatcttcaagatttatccctccgaaagtcggttctaaagcagcgataatttctaccaacttatcaggatcttgttcatctacttcaatatcaaatacatcaacaccggcaaacttcttaaataaaacacctttaccctccataacaggcttaccggctaacgctccaatatttcctaaacctaatactgcggttccatttgatatcactgcgactaaattgcctctggaagtatatctataagcagagacaggatctgcttggatttctaaacaaggtacagccacccccggagaataggctaaagctaaatctcgttgtgttcccaatgattttgttggtgtaacttcaatttttcccggttttggaaactcatgaaaatctaaagcggcttgacgtaattgtgcatccataatttttccttatattaactatttacttcatttcaactttgctaaaaaccaattgcattatagacaaaaaaataggcaaaaaagtaacacaaaaattttatttacatattttaccaaattgtatgatatacagaattaaacacaaaaacaggcatatatttttactatatgcccattgaaactaaagagccattttacttatgtaatgtagctttgtaggttgggttcattaaattctccacagaaagaatattatctaactgctcttctgttaataagcccatttccagtacaacttcacgcactccacgtcctgttttagcacatgttttacctactatatcgccattatgatgaccaataaacggattcaaataagttacgattccgatggaattaaagacataattttcacaaatttctttatttgcagtaattccatcaatacatttatcacgtaaattcacgcaagcattcgttaaaatttcaatactttcaaacatggcttgaccaattaccggttccatcacatttaactgcaattgccccgcttcagctgcaaaagttacggtagtatcattaccaatcactttgaaacaaacttggttgactacctcaggtacaaccgggttgacttttgccggcataattgaagatccagcctgtaactcaggtaaattaatttcatttaaacctgcacgtggacctgatgaaagtaaacgtaaatcattgcatactttagataattttaccgcagtacgttttaacgcaccgtgtaccataacataagcaccacagtctgaagtggcttcaattaagtttggtgcaactgtacaaggtaaacctgaaacctcagataaacgcttaacaactaattctgaataaccttgaggagtatttaagccggtaccgatagctgttgcacccaaatttacttctaacagtaattcagccgtgcgggttaaattacgcacttcttcatctaataatacagaaaatgctttaaattcttgccccacagtcataggaactgcatcttgtaattgagtacgtcccatttttaagatattcgaaaactcttttgctttattttcaaaaccttgttgtaaataaagtactttagttaccagtttcataatactgttataaacagcaatgcggaaacctgtcggataagcatcatttgtagattggctggcattaacatgatccatcggatctaaaatatcatattcccctttcttatgacctaaaatttctaatgctaaattagcgaccacttcgttggtattcatatttacggaagtaccagcaccaccttgatatacatctgaaggaaattgatccatacatttaccatcaattaaaatcgcatcacaagctttcacaatcgcctgagcaattttatccggaattgcacccaattctccatttgcaagtgcggttgctttttttaccatgaccataccacgtacaaattcaggtacatcagaaatcgttacattagaaatgttaaaattttctaccgctcttaatgtatgaatgccccaatacgcatcagctggaacgtcacgttcaccaagcaaatcaatttcttttctcgttatcatatttctttcctttttaatttttcagactaaagaatgtaagtcattataggatagatagtcgtttaaaaatgtgatcccgatcacttttcagcactcctctcaccaatatattttttataaaattcattagttttttttatggaaaattaaataaaaaatacccttgaaagaaccaaaatatcccccatatagggtgagctttaattttttattaattattaataaggaacccaaacaatgaatattcgtccattacatgatcgtgtcatcattaaacgtgaagaagtagaaactcgctctgcgggtggtattgtcttaaccggctcagctgcaacaaaatccactcgagcaaaagtattagctgtgggtaaaggtcgtattttggaaaatggtacagttcaacctcttgatgtaaaaattggtgatactgtgattttcaatgatggatacggcgtaaaagcagaaaaaattgatggtgaagaagtgttaatcatttctgaaaatgatattttggcaatcgtagaataaaaacaaattaaattaataggaatacagaaaatgacagcaaaagacgtaaaatttggtaatgatgctcgtgtaaaaatgctagcaggtgtgaatgttttagcagatgcagtaaaagttactttaggacctaaaggtcgcaacgtaattttagacaaggctttcggtgcacctactattactaaagacggtgtgtctgtggctcgtgaaatcgaattggaagataaatttgaaaatatgggtgcacaaatggtgaaagaggttgcctctaaagcaaatgatgctgcaggcgatggtacaaccacagcaacagttttggctcaagcgattgtcagcgaaggtctaaaagcagtagctgccggaatgaatccgatggatttaaaacgtggaattgataaagcagttaatgcagtggttgaagagctaaaaattctttctaaaccttgtgaaacgtcaaaagaaattgaacaggttggtacaatttccgcaaacgccgatgaaactgtcggtaaacttattgctcaagcaatggaaaaagtcggtaaagagggggttattaccgttgaggacggttccggtctttcagatgaattggatgttgttgagggtatgcaatttgaccgcggttatttatcaccatacttcattaataaaccggaagccgcaactgttgaattagataatccgtttattcttcttgttgataaaaagatctctaatattcgtgaattattaccggtcctagaaggtgtagcgaaagctggtaaaccattgttaattatcgcagaagatgtggaaggcgaagcacttgcaacgttggttgttaacacgatgcgtggtattgttaaagttgctgcggttaaagccccgggatttggagatcgtcgtaaagcgatgttacaggatattgctatcttaactgcaggtactgtcatttcagaagaaatcggaatggagcttgaaaaagcaactcttgaagatttaggtcaagcaaaacgtgtggtgatcaacaaagataacacgactattattgacggtattggtgatgaagctcaaatcaaaggtcgagttgctcaaattcgtcaacaaattgaagaagcaacttccgattatgataaagaaaaactacaagagcgtgttgcaaaattagccggcggtgttgctgtcattaaggttggtgcggcaactgaagttgaaatgaaagagaaaaaagatcgtgttgatgatgcgttacatgcaacgcgtgcagctgttgaagaagggattgttgccggtggtggtgttgcattaatccgtgctgcaacaaaagttgcaacaacattaaaaggcgataacgaagatcaagatgtaggtatcaaacttgctttacgtgcaatggaagcaccacttcgtcaaatcgtaaccaatgcgggagaagaagcttctgtagttgcaagtgcggttaaaaatggtgaaggaaacttcggttataatgctggtacggagcagtatggtgatatgatcgcaatgggaattttagatccgacaaaagtaactcgttccgcactacaatttgctgcatctatcgcaggattaatggttacaactgaatgtatggtagccgatctgccgaaagaggagaaagctgatctgacaggcggaatgggtggtatgggtggaatgggcggtatgatgtagttctccccatattccatatccaatcattatgttaagaagggtcgtcagaccctttttatttttcaaaaaacgtagaccttaattattagctatctagaagtctagattgttattttgcctattttttattagaatactcaatattactaaggttattaaggatcaacgaaatggcagattgggacggaaaatatattagcccttatgcagaacatggtaaaaagagtgaacaagttaagaaaattaccgtttctattccaattaaagtattagaaattttaactaatgaacgcactcgtcgccaactccgtaatttacgtcatgcaacaaatagtgaattattgtgtgaggcgttcctgcatgcttttaccggtcaacctttgcccacagacgaagatctattaaaagaacgtcatgatgagattcctgaaagtgcaaaacaaattatgagagaattaggaataaatcccgatgactgggaatattaatagattaagtttggtaagttatttcagcaagtgcggtcgttttgaccgctttttcgctttttattagtgaatttcactcgggaatgttacaatccgctaccgttataacaatagagataaatacaatggctcgtacaaaaaaaactcgtcgaataacagatattatgcctatgcgtaaaacagataaacgtccggaaaatctgtcacgtcccggtaagaaacttactcgttatgaacttgatgctaaatctcgtgaagaaaaaaagaaaaaaaaacgtaaaggactaaccgctggttcacgtcatagtgcagtagatacaagtaaaacaatcgtacttaatgaaaaaaaagatcctcgtgttgggagtcgtaaaaaagttcctcttattgttgaatttgtgaataaacctgaaaaaggtatgtttattccttcaggtgctttagaggaaaaagcgaaaactattgatccgatgctggaactgacacaactcgaaaataatgaaagtttaaatcaattattagatgagcttgatgcaggtaaaaccttaagtaaaaaagatcaaatctttgtcaatcaatgcctagaccgtattgctcaacttatggctgaacttggaattgaagaagaaagtgaagatgatttgtaccgcacttttgagactattgatattaaccaatttaaataagctatgtggatcacaattttaatcattctcggcggattaattattagcgttatgcttggttacgcaatatatttattgctcgttttacaaaagcagaagaaagtttttttgcaagcaaaacaggctagactaaagcgtttaaaagaaagttgtgaaattatcgctaatgcaatgcaaagtggagaatgcaatttatctgaaggtgttatccgtctaaaaatgttgcttgaaccgttagggcattcattgaaaaattacacttcaatgtaccaactctatgaagcagtaatggatatgccgacccatgatgctcgacgaacattaaagaaaaatgaacgtatgcgtttagatttacaacgtgaacgtgctgaagctgatttagaacaaaacatcaaacttgaaattcagcgactgttaaattacctaaaagaatctaaggaaaaataaatgtcagaaattatctgggatttagcattaatccaaaagtataaccattcaggtccaagatatacctcctatccaaccgcacttgaattcaatgaaagctatactgataaagattttcagcaagctgctactcgttatcctacacgtccgctttctttatatgtacatattccattttgtcataaactttgttatttctgtgcttgtaacaaaactattactcgtcatcaacataaagtagagatttatcttgattatttagaaaaagaaattcaaacaagggctccgttatttcgtcatcgcatcgcaactcaaattcactggggaggcggtacaccgacttatctttcagaacaacaatctgcacgtttaatgcaaatgctgaaagagaattttactatttcagataaggcggaaatcagtatagaaatggatcctagagaaattgagctttctatgctggatcatttatacaaaattggttttaatcgtattagtatgggggtgcaagattttaataaagatgtgcaaaaagcagtgaatcgtgaacaagatgaagaatttgtgcgtgaattgttgattcgtgctcgtgagttaggttttcgctcaaccaatctcgatcttatttatgggttaccgttccaaaccgtagaaagttttatgtttaccctacataaagttatcgaactcaatccggatcgtttgagtgtatttaactatgctcacttaccaagccgtttcgccgggcaagcgaaaattaaggataaagacttaccaacacctgaaacaaaactaacaattttgcaaaaaactatcgaaacgttaggacaagcaaactatcgttttattggcatggatcattttgctaaaccggatgatgaattggcaattgcacaacaaaaaggaattctacaccgcaatttccaaggttataccacgcaagaagaatgtgatttattaggtttaggtgtttctgccattagtttattgggcgatacctatgctcaaaaccaaaaagatctcaagcaatactataccgacgtagaagaaactggtttagcattacacaaaggcttggtgatgacgcaagaagactgcctacgccgtgatgtgatcaaacaattaatttgcaattttaaattagattttcaaccgatagaacaacaataccaaattgatttcaaaacccattttgctgaagatttagctttgctccaacccttagcaactgacggcttagttgatattaatgacaatgcgttacaagtatctgctaaaggtcgtttgctcattagaaacatttgcttgtgttttgatacatactccagacaacaagcaaaaagacaacaattttctcgaattatttaacgaaaaagtgcggtcaaaattaaccgcacttttttaacctcgctgtgcatttttcataatgcgatctttcgttactttccattcacgatctttaatatcttcacgcttatcatgtaattttttcccttttgctaaacctattttcacctttgcccaaggacctttccaatataatgaaagtgcaacaatagtgaaaccatctcgatttgctttaccaaataatgaagccaactctttctggtttaataaaagtttacgtgttcttgtgggatcgcaaacaatatgcgttgaagcaacacttaacggctgaatggttgcaccaaataaatatgcctcgccatgcttaaaaataatataactatcgccaatactcgctttacctgcacgcatcgatttaacttcccagccctgcaaagaaagaccggcttcgatttcatcttcaataaaataatcgtgtcttgctcgtttatttaaggcaatcgtattagatgctacctttgcttttttctttgtcatataaattcatatctcattaaaaatttttcgcattttacccaatctaagcaaagatcgcaaaaaggcttgcattacatcgcattctctataacaatgcggatattcttgataacccgttacgcaaaatatgaaatataaaaatctacgagattttcttgaattattagagaaacaaggtgagctcaaaagaattacacaggaaatcgacccttatttagaaatgacagaaattgctgaccgcactttgcgtgccggtggtcccgcattactttttgaaaatccaaaaggctatgaaattcctgtgctttgtaatttatttggtactcctaaacgtgttgctcttggaatggggcaggaagatgttaccgcactgcgtgatgtagggagattactggcttttctaaaagaacctgaacaaccaaaaagttttaaagatttatggtcaactcttcctcaatttaaacaagtgctaaatatgccaacgaaagttttgagtaaagcagagtgtcagcaaattgtattctctgatgctgaagttgatttatataaattacctattatgcactgttggaaagatgatgttgcacctttagttacatggggattaaccatcactaaaggaccaagtaaaaaaagacaaaatttaggtatttatcgccaacaattaataggaaaaaataaactcattatgcgttggctatctcaccgtggcggtgcgttggattttcaagaatggaaagaagcacgccctaatcaaccctttcctatttcagttgctttaggggcagatcctgccactattctaggtgcggtcacaccagttccggataccttatcggaatatgcttttgccggattattacgtggtaataaaacggaagtggtaaaatcaatcagtaatgatcttgaaatacctgcaagtgcggagattattttggaaggttatattgatccaacggagaccgcacttgaaggtccatacggagatcatacgggttattacaatgaacaagaatattttcctgtatttaccgtgacacatcttaccatgcgtaaagatccgatttatcattcaacttacacaggtcgtccaccggatgagcctgcagttttgggtgaagcactgaacgaggtttttattcctattttgcaaaagcagtttccggaaattgtcgatttctatcttcctccggaaggatgctcttaccgtcttgcagttgttacaataaaaaaacaatatgcaggccacgctaagagagtcatgatgggagtatggtcatttttacgccagtttatgtacacaaaatttgtgattgtctgtgatgacgatataaatgcacgagattggaaagatgtgatttgggcaattacaacacgtagcgatcccgccagagattgtacaattatagaaaatacgcctattgattatcttgattttgcctcaccgattgctggtctcggctcaaaaatgggaatagatgcgacaaacaaatggattggagaaacgcaacgtgaatggggaaccccaattaaaaaagcccctaatgtagttaaacgcattgatgatatttgggagagtctaaatatttttgctcccaaataaacagcaaaaggtaaataagtgcggtgcttatttacctgtttatttcaaacgctcaaatccggctttaagatcggcaataaggtcatcaacgtcctctaaaccaatatgtaggcgaattaatgtaccggttaatttgcgttcaatattaggtctaatcctagcgatttcttccggttgagtgcataaaatcagcgattcaaatcccccccacgaatatgccatagtaaaaatcttaaaatgatccataaaattttctaacgcctgttgagaaagttttttatttagttcaaaagaaaataatccgctggaacctgtaaaatatcgcttaaaatattgatgccccggacaacttggtaatgccggatgataaacagtttttacttcaggctgttccagtaaccatttagctactttaattccattttcttgatgctgttttaagcgaactagtagagtacgaataccacgggctgtcatgtaggcggtatcagcatcgaccatctgccccattaaataagaattttcacgtaattgttcccaacaacgtgcattagccaccgctgtaccaatcatcgcatcagaatgcccaatgagatattttgtccctgcctgaattgaaatatcaacaccgaaatccaaagccttaaaaaatacacctgcactccaagtattatcgatcataactactattttaggattgatttggcgagcagcttgcacaatcgatacaatgtccggcatctccatagtaagtgaacttggtgcttccaaaaacaagactgtcgtatttggttgaactaaatccgcaattttttcaccaattaaaggatcataaaatgtggttgtaattgacattttctttaaaattatatgacaaaattcttgcgttggttcataagcagcaccgctcattaacacatgatcaccggtttttacaaaagctaaaatagcattacttaccgccgccgcaccgcaaggatagagatagcaaccctcaccaccttccaattcacacattaattcttgcaaagcaaaatgtgtcaatgttcctcgacgtccataaaataatccaccttttgctcgattgatagttgcttgttttttatctgctaaagtatcaaaaaccaatgaagatgcacgctgaataacagggtttaccgcatttttacatactcgtttattacgccctgcatgaattgttgatgtggtaaaagaagttgtattactcatagaaatatccattttaaacaaaaatcaagattataataattgatttaatagccaaaaactaatacaaaagtgcggtcttttttcataaaataattgtgcgaatttgctttagaatgcaaaattcttaataacttttataggagatttttactatggtattagttactcgtcaagccccagattttaccgcagcggcagttttaggcaatggtgaaattgttgaaaaatttaatctaaaacagcatattgctgggaaagcggcggttgtttttttctatccaatggactttacttttgtatgcccatctgaattaattgcatttgatcatcgttataaggaattccaagatcgtaatgtggaaattattggtgtttcaattgattctgaatttacacacaatgcatggcgtaacacaccggtagataacggcggtatcggtcaagtacaatatgctttagtggcagatattaagcacgaaatcgcaaaagcttatggcattgaacatcctgaggcaggtgttgcattacgtgcatcattcttaattgacaaagaaggtgttgttcgtcaccaagtcgtaaatgatcttccattaggtcgtaatattgatgaaatgttacgtatggttgatgccttacaattccatgaagagcatggtgaagtatgtccagcacaatgggaaaaaggcaaagaaggtatgaccggtagcccagaaggtgttgcaaaatacttgaaacaaaatgcagataaactttgatctcatcaattttaactaaaactagccccgcacttatgtggggctatttcattataaatctagtcattcttataagatcctctgaaaaataggaataacattattagcaataattttccatgaggatatacaaaaaagctcccaaaataaattttaggagcttcaatttttatttcataaataattagcgacgtaagcctaaacgtgcaattatttctgaatatttagcaagatctgtacgttttagatagtctaaaagtttacgacgacgagagaccatgcgtaataaaccacgacgaccgtgatgatcttttttatgtgtagaaaaatgagcttgcaaatggttaatttgtgcagtcaataatgcaatttgtacttctgaagaaccggtatctttcgcatcacgaccaaattcagcaacaatagctgcttttttttctgtacttagagacataaacattccttatactaaaagggttgataatacatcattcgccgatctctaactcagcgatgacaggaactgcagattttatctctcgattataaaaaaagcaataaataattactcaacatacaaactagacctacttacaatgttaccgcattatttatgcgtattatgcgtaaaaactaaaaatgaaggatatatttttcttgattttatagcaagaaagataaagaatattaactaataggattataattaattaagatatttaattttagataagtggcataagtggctaaaaatgttccacataaagtaggataaaaattttctcaatctattcaatcaaatttttggagatttatattatgacaatacaaccagatccaacttctgtaaaaacgcactttcaaggcaatgacaaactattgtttggtatgattatgggagtgattgccttttggctttttgcacaaaccacgttaaatattgcacccgatatggagcaagatttaggtgttaacaccagtattatgaatattgctgtatcaattacagctttattttcggggatgtttattgtcgttatgggggggcttgcagatcgtatcggctgtttaaaaattttaaatttaggttttttattgagtattattggggcattgttaattgcactggctccatctggtgatttagctgtcccactattaatgttagggcgtattattcaagggatatctgctgcttgcattatgccatctagtttagctttagtaaaagcctattgggagggtgaagctcgtcagcgtgctattagtatgtggtctatcggctcttggggtggttctggtttatgtgcactcttcggtgggttagtatctcaaaatctaggttggcgttatattttctttgcttgtgccgctttatctttattaggttatgttatgtgtcgtggtaccccagaattcaaaatggaagatgatggaaaaaaacataaatttgactggggaggtgttgttacctttatgattgccatgatcgctttacaagtattggtgactcaaggtggtgatttcggctggacaagcatgaccactatcggtttattgctagtgacttttgtgtcaatcgtattatttttatggattgaggagcgtgctgataaagcgtttgtggacttttcactttttaaaaatgcgacttacactggagcgactatttctaacttcttgctcaacggtgtagccggcatgttaattgtatcgttacaattagtacaattgggcggtaatatgactgcacaatctgccggattgctcactattggctatgcgattgcgattattgcttttattcgtgtgggggagaaattattacaacgttttggtgcccgtaaacctatgatttggggctgcctaattacaggcttttctattgctttgttattaccaacgaatatgatgttggatcaatataagattatcgttgttatttcttatatcttatttggtataggtttagcattttatgcaaccccatccactgatgccgcattatcaaatcttccgcctgaacaagcgggggcgggttccggtctctataaaatggcttcttcactgggtgcggcatttggtgttgctatttcagcggcaatcttcaccgcactccgtgcagagaatgccagtgtatcttggttaaataacatcgtcccttttgttggtcgccaagataatattgctattcgtgaagccgctattattgcattaatgtttaacttattgatgatttttggggctattgtgtctattatgttgactgtgccaacgggcaaaaaatcatcctaaccacagtatttacttgatattcaggctacctaaatcattccggtagtctgaaaccctaaaaaaccgggttcagtaaagaaaaaatcatgactatattatttacaatctatcaccccaagcaaatcggaaaaagcaacgtatattttcgttatatctaccagccactatatatttagtcaaaaaaatctacgtctaaatttattggcggtttcgtccaattttggggtatagatcattttgaccgttctttttattttttgcataatagccactttatttttatccgtctcttacgtatggagcattctatgctgacagaacaatctaaaaaacataccgcacttttgtcttttttacctgtattactcctaattgctattgatttctttaccatgagtttacaagctcaagcaaaagcaatttcccatttgagtttagctgtattagttacacaattattatgtattttagtgtttgccaaaggtgaaatttgcaatggtcagcgtttcagattagtaaaggtaaacttatattttttgatttattgggggttatggctgtttatcagtttattttccaattatcactatgtattaactgatattgtatgtttgtgtggcattgctttaactttggctatttggcaacaacctcaagatttgcaaatgcgtaagtcattgttggttttaggaacacttgtgggagttttaggtatagtaacttattgtttaatgtttattgatttacctttactttatttttctcaatataatccagtagctcaagcattgctaggcatcatattagcgaatttattgctagtcatcgctaaaaatcgtttacaaggctttattatcttattgccttttttgatgctgattactttattactgaatgcaattattgtgttaggtattttgttttttgctatatcacaacaagttgtattttctaatgagttttcttggggactttattttattttacatttacttgttactggcattattgctatacatttattttacaaatggaaatttgaatattacaccttgttaataatgagttttattgtaatgagttttcctttatgggtaagttttgcctatgtgttttaactaaaacaactgcctactttttggaaatgattgatcattgatgagtatgtatgttatcagataagagaaaagcggacaaaatgctttattttgtccgctttgtgtaatattgagaggactaaatgttaagtacagcaattaaagctaaaatagagtaaagtactgataatccgtagaaaataatcccacctgctggaatatgaagtttaaaatcatgtgtgccatggtgaattcgatgcattgccccccaagttggaaaaactaatacaactaatagaatcagtttacctaaccaagaaccggcaaaagcaataatattgtctgcaccgttttcgattaatccaaaaggtagtaatagacctaggataaaaatcaatatagggaagacaattgcacttactgtagtacctgcaccgaacaataaccatacaacaggttcgttagagcgttttggagtttctttcatcttggtctccctatttcaagtaaattagcactaaagcaagaatacttactacggctgtaacagcccacataccgatagtaataacattcggatttagtttttcatttttgtacacgatatttagcacttttggcgtcatgaagaaatacgtaactgtattcaaaatggctgctgccaaggcgataatattcagaataataacaattggattttgtaagaaaggaataaaatccgattgcaatccatctttttgacctaggcagatcacgccataaagtaataccaagctaaaccataatgatggaattgctgttgcttcacgcataatgtaaagtttgtaaaaatctagctttttccaccaagttgcttttacttcccgcacatatcttctgcgtttacttgttactgttgtcattttacactccttacttttgcggttttaacattgcaatgacgaaatcttttgcactttcgactttaccttggttgacaccagaagcaggatctacatgtttagggcagacttcggaacaataacccacaaaagtacaactccatacgccattcttaccgttaataattttcatccgttctgcttttccgtgatcacgattatcaagattataacggtgagcaagagttaagactgccggaccgacaaattcgggatttaagccaaattgcggacaagcggcgtaacataatccacagttaatacacatagagaattgacgatatttctctaattgagccggcgtttgtttagtacgactttccgccaattccgatgacgtatgtggtttaccatctaattcaggtgctttattgcctataatatatggtttgatactctccaaactttcaatgaagtgactaaggtcgaccactaaatcccgttcaatcgggaagtttgctaatggttcaatacgcatatgaccactataatcacgtaaaaaagttttgcaggcaagtttaggtttaccgttcaccatcattccgcaagaaccgcagattgccatacggcaagaccatcgataagaaagttccggttctaatttatccttaatataacctaaagcatctagtaaagatgtttgactgtcataaggaacttggtaagtacgtaagtatggctctttatccgcctcaggattataacgcaatacttcaatattcattattgcttgattagccatttgcttgctccttagcttttgcagccgcttcttgtgcttcagcttccgcaccgtaaacacgttttgctggttgagatttggtgattttcacatcgctgtattcaatccgtggggcaccatcagcattataatatgctaaagtgtgttttagataattcacatcatcacgctcagtatagtctaaacgttggtgagctccacgagattctttacgttcaatcgcagaattagcaatagattgagcaacatcgagaatataacctaattcaacggtatagagaacgttggtgttaaatacgcttgaacggtctgcaatacggatatgtttataacgctcttttaattctgcgattttatccacggtttgttgcatgctttcttgtgtacgataaatgccgcaaccttcttccattgaatcgcccatttcatcacgaatttgcgaccaagattctgttccttcttgattgtataactcttctaaacgatggataacatcttgagcttgagcatcgaccgcacttcggttagcaggttgtgcttcaattgcacgctgtgctgcatattcacctgcaacacgtcctagcaccactaattctgctaatgaatttgaacctaaacggtttgcaccatgtaaaccagaagacgcacattccccaacggcaaataaacctttaatacgggtttcgctattgaagtccacttcaataccacccatggtgtagtgtacgacaggacgaacgggaattggtgctttggcaggatcaacaccttcgtaagcattggctaattcacagataaacggtagtcgttcatgtaaatatttttcccctaaatggcgaagatcaaggtgaacaacatcaacaccttttgctgtttttaacgtattgcctttacgccattcttgccagaaggcttgggaaactttatcacgaggacccaattccatgtatttattttccggttttccgataggtgtttccggtccgagaccataatcttgtaaatagcgatagccatctttattcaccaaaataccgccttccccacggcaaccttcagtcattaagatacctgtattcggtaagcctgtcggatgatattgaacaaattccatatcacgtaacggcacaccatgacgatatgccatcgacaagccatctcccgtaacaatccccccgtttgtgttgaaacggaatgcacgacaaccgcctcccgttgcaataatgaccgcattagcattgatttgtactagagtaccttccatcatattcatcgcaaccataccacgagcatgaccgtcatcaactaaaatatctaatacgaaatgttcatcaaaacgctgaatttgtgggtactgaatggaagtttggaagagagtgtgtaacaaatggaaaccggttttatcagcagcaaaccaagtacgttcaattttcataccgccgaaacgacgaacgtttacatcaccatcaacttttctgctccaaggacagccccaacgttctaattgagtcatttctaccggagagtgttgaacaaaatattccaccacatcctgttcacacaaccagtctccaccggcaacagtgtcatggaagtgtttatcgtaagagtcctcatccttaattactgcagctgccccaccttctgctgcaacagtatggctacgcatcggatatacttttgaaactaaagcgatctttaaattaggatttgcttccgctgctgcaattgccgaacgtaaaccaccaccaccggcaccaacaattgcgatatcgacattaactgtttgcacgatattcctccaataatagataagagtaaaaattaatccctaacgggaaatcacaaaagcaatactattctgccactattttaaaagagatataactcttttttgttaatttaagctagaaaattttaatttcgtgatctaactcaaaactatatttgaaatagataagaaatattctcattaatttaaaattagatgataagcaatatcatttattaacaaaaacatagcgttactattagaaaaattgatttgtcgcattattatttttttcaggtagaatatttcaaaaaatttataaaggattttattatgtctttgaatgaacaatggcaacctagtgcctcgatccaaaatttattggcaagagcaaaaattattgcggatattcgtcgtttttttacagagcggggattgttggaagtggaaactcccgtattgagtgaatttggcgtaacagatgttcatctttcgactttcagcacagcctttacatctccgtttatggaaaagtcaaaaactttgtggctaacgacaagccctgaatatcatatgaaacgtttattggcagctggaagcggtgcaattttccaattgtgtaaagtatttcgcaatgaagaaagcggcaaaaagcataatccagaatttacaatgcttgagtggtatcgaccgcactttgatatgcatcgtttaattaatgaggttgatgatttgttacaacaaactcttgattgtgaaccggctgagatggcgagttatcaatttgtatttcaggaacatgtaggtatagatccattgtctgcaccgattaatgaattgattgaaaaagcaagagaatgccatttggacggtgctgaaaatgaggatcgcgatacgttgttacaatttttatttagcacgcttgtcgaacctaatattggtcaaaacaaacccattgtagtttatcattttccggcaactcaggcggcccttgcacaaattagttcagaagaccatcgtgttgcggaacggtttgagttttattataagggaattgaattggctaacggttttaatgaattgactgatgcacaagagcaagaacatcgctttaatcaagataatcgcttaagagaacaattggggttaccacaacatgagattgatcatcgttttttaggtgcattacaagcggggttgccaaatacagcaggggtggcattgggagttgacagactcattatgcttgctttaggtgctgaaaatatcagcgaggtgatttcgtttaatatagattgtgcttagaataaagtttttgtatcacattgcgaaaaagaatttttacaaataacggtaaattattctttcaaactaatttgatgtgaacccaaagattgtttacgattaatcattgcatgaactactaattgtgcagttttaatagcatgataaatttcaatactgtgaatctttttgagatcaataggacaatttttttccaaatgttgtagttgtgtaattaaacattgcaaattttttttagttctatacacattggcaaattgattcattaatgatcttacttgtcgcaatatttcacttgatgagtgagcggattttttctcttgattggctaaatgttgtaaatagcgtattccctttaacacataatgttctttattttgtgtagaaaagtgcggtacattttccacaactttttgtatcgctcttttggcaaacacgaggctaccgcctacagagttccctcctagacgatttgctccttcaatacatgcagaaacttccccaaccgcaaataacccctgtactgctgtttgggcgtattcattgatttcaattccaccgttgcaactatgagcaaaaggtcgaattattacctgatctcgcaataaatgaatatccatttctttttccagccaagttaaatagacttgataaaattccgttttatcatggtaaagttcgggagaataatgtagatacactcctttctcagtaggattttcaatcaaatgtttcattattacgagatcaaattcaacactttgaaaatccacactaaaaggtgcatagctactacgttgtcgtatcattttttgaaattgttgcggtgataaatgagaaaataaattcttacctttgctatcagtaacctttatcagatattttaaagtatgctcaccgaacaatactttatacttaggtttaacaaaagcaggaatgaattgaataaattcaagattggttaattttgcacctgcttgataagctacatagtgggtcgaacctattatatctgcaggatagagattgtcttgatacaaccctgcaataccgcctgtggctaatatgatattattcgtgtagcaaaaaatatagcgaatctcaccgcccttttgttgagcaaaaatagcacctttaatttgattttgttcagtaacaatatgtaataaaacagagttttcataaaattctatttggtgctgaattaaaatttgtttagcccgtttagcactttgtttccagttattaattaaatagatcgggcgagtatagtatgcaaagcaagcagggcggttatcttgtcgtagccaaggagtaaatccaattttactcaatagctcaatagcttgtggtgattcttccacataagccctaacaatcttaggattatttactccacaagcgactctctcaatttcttgttgaaagagaattttgtcatcggaatcccctgttatttgaataccaagtgtcgcttttagcggaaaaaaacttgcacctccacctattattgatttgctaattaaaatcggattaagtccttttgcttttgcctcaacacagcatgctaaccctgcaataccagctccaacaatcaataattccgtttcaatttggtggtgaaatttaatatttgtcataatctataaatcttttattaaagataaattcaatgcccacatcacaaaaatatcagcaatatcttctgcttaattaactactacaataatgatggtgctgcattgagtaaaattttggtatattcctgttgcggattattaaaaacgtccattgcatcaccttgttctacaatcaagcctccattcatcaccacaatacgatcagatacttgacgaacagtttgtaaatcatgagagataaacaccattgcgagatttaactcttttttaagatcggcaagtaaatttaacacttgagcccgtacagacacatcaagggcagaagtaggttcatccgctacgattaactttgggtttaatgccaatgcacgagcaatagcaactcgttgtttttgtccacccgacagtcgtgtaggttcaaccaatgctgcagagcgaggtaatcccactcggaaaagaagttcatacacccgtttttcacgttcatgggggtgcagtacattatggatattcattggatcttttaatatatctattactcgcattcttggattaagtgcggtggcaggatcttgaaaaatcactgaaacttgtcgtccgaattgtttgcgagcctctgcacttccgtatttcatctttaaaccgttaaattttactgtgccggaagagggtttttgtaaaccaatcataacattggcaagcgttgatttaccgcaacctgattgtcccactaaacccaaagtttctccggcctgaatatttaggctaataccatctatagcagtaaattttttcggattaaatattgaaccatcacgggaaggaaattgcaccacaatatcttgtaattcaatgattggttgtttttttaacactttcatactcatgttttaattctccaaatgcgatgcccataaatgtttcggattatcttctgcttgtactaatttcaaatgttgatttggatttgcattaggacgaagagaacgactggcaaatcgatctccttcagcaaaatcaaaaggcgatggtacactgccaggaatttgatacaagcgttccgctctacactcagtagaaagtactgaacccagcaaccctctagtatattcatgcattggattcattaataatgaacttgttggagcgacttctactacctgccctgcatacattactgtaatatgatgagcgatttgtgctactaaggctaaatcatggctaacaaaaaccatagcaaagcccaatttttctcgtaattcattaagtaatttaattacttctgcctgcactgttacatcaagtgcggtagtaggttcatcagcaatcaataatttcggttctctagccaatgccattgcaattaatactcgttgacgttgtccgcccgataattcgtggggatagcgatttaacgttttttcaggctctaatttaacccatcgtaaaagtgtttccgcactttgttttccgccacgctgaatcagttgtgccatttgatctttaattcgcattgatgggtttaacgcacttaaagcatcttgataaatcatagaaatttcgtgaccacgtaaatcatttaatttatctgttttcaataaatcatgttgatttcctgcacgatctgtaaaaagtatttctcccgtaatcttggctgttttaggcaataatcccataatggaaaatgcagaaattgatttaccacagcctgactcgcctaccagccccatagtttcaccttcatgaacagtaaaactaatattatccactagtggaatatcaccataacgatttggaaaacgaatagataaattctttacttgcaaaattggcttcattgctgaattaagttgcattctatcagtacgttccgattctttttgatttaattttaataaataacgtttaagtgctaaactttccgccatagcttcttgtacatcggtagcaagaggctttgatacatcacctttgttatttggattacgtttaagttttggattcacgagagcatcagttagtccttctgacaaaatattaagtgataaaacggtcaacaaaatcattaatccagcaaaggtagtggcccaccaaaagccacttaatactaaatttcgaccttcggataaaacatttccccaagatggataagggggttgtactccggctcctaagaaggaaagagaagcttccaatacaattgcatctgctaccatcactgtagcaaaaaccaaaacaggggcggcagtattgcgaactacatgctttaataaaatatagcttctactgccaccaattactcgctccgctctaatataatcttcttcccactgagaaactacattagctcgtacaacccttgctaactgtggcgtataaactaccgcgatagttaaaataataatcggaacagagttaccaaaagtagccaataataccgcagctaatgcaattcccggaaatgccattaaaatatccattagacgcatgatgacttcattaccaaatttactcgctgtagcagcggttgcacctagtatgctaccaaaaattattgcaaaacctaccgcacctaagccaataaacaatgatgttcttgcaccaaacactaaacgagagaaaatatctcgtcctagacgatctgtgccaaaccaatagtcactatttggtgcttgcaccggtcgtaaggtttgtaatggatcataaggagaaacccaaggtgcaaaaatagcaattaatgcaatcaacatgataaacattaaagcaattttagaggccattgataacgctttgaatcttgctccgccttgagcaagtctttcggctaatccttgacgaaacatcataaactccgaatttttggattgatcacaaggtacaatacatcaacgataatattgaccagtacaaaactaaaggcgattgttagtacaacaccttgtactaaatgcaaatcatgattgacgataccgttaaaaattaattttcccatacccggcaggtcaaaaatttgctcaataactaccgcacctcctagcaaataaccaattcttaaccccaatacagtaacgggggtaatcaacgcatttcgtaatacattatgacgaataacggttgcataaggaacgccattaccaatggctgttcgcacataatctttatccatttcttccaccatcgtagttcgtacaacccgaattagagatgcacacacaggtacagctaaagcgagtgaaggcaaaatcatcgaataaaaataaccgctcggatcttcactaaaagaagtaaatccgccggaaggtaaccaatccagttccagtgcaaaatattgaattaacaaaatcccaagccaaaaagaaggtgttgctacagccgctactgataataaacgaataatttgatcaatccatgtatctcgataaagtgcggcaataacgcctaaggtaaaagaaactattgcagcgaggaatacaccaataaaagttagctgtaaagttagtggaaaggctttcgcaatcaaagaagtaatcggttgttcaggtggtgtggtcataccgaaatttaagtgaattaaatttccgataaaacgaaaatattgcacaattacgggatcatttaaaccgtgctgttctcgataaagttgctttgcagcctcacttgcaccttcccctaatgcgacagtggcaggatcacccggtgtaaattgtaagataataaaaaccaaagcactcacacctaatatcattatgggtaatgccgctaaacgacgaagtaataagcgaaagacaatttccattatttttctccaactatacaaaccaagtcagtagaatgaatctgctatcaataaagataggggctgttaatcataaccacatataaatgaccgcactttctgctcattaaaaacaagcagaaagtgagaaaagttaattatttgcgacctacaccaataaatgaaagtccggtagttggaattggttggaaaccatccagtgatttgttattccaagcggttggtaatttacggtgcaaaattggataaagcggtacttgttcagcaataagattaatagcctgagtccaagccgcttttgcatctgatggctgttttgctttaattgcatcatcaagtaataattgcaatttcgcatattcaggggtatctgaccaaccgaagcgttttttcggccaaacatcaccacgataccaccagctcaataagagatccaaatcgttgctaaatactgatggatcccccggtgccattacgacttcataatttcctttgtctacgtaaccaccatacaatgctccagattgtagatgctgtaaagttactttcacacccggaattttattccaagattctaaaactaaaggggcacattcttttatccaagaatgatctgtagaaagcaattgaaattctaatttattcagacctgcttcttttaaaagtgcggtggctttttcaggattataatcatactgggttgaagccttgacataatcaggatgcgtatcttgagtgtaagaagtggcggcttttgcattacctaagaatacaatatcaattaatttttgtgtatccagtgcatagtgtaaagcttgacgtactttgggattgttaaatggggctttcttacaattaaacattaagaataacaatccgaaagattgcacggattcaaccgcacttttacgttttaagcgagatgcgtctaaataaggaacactttccattgcttgagtacgtccggactcttgtgccgctgtgcgagcggcatcatcggatagtaaaaaccatgtcattttttctacacgagcaggatatgggccgttgtaagcattgtgtgcggcaaatacgatgcgatcgtcttttacggctgaaacaaatttatatggtccggatcctaccggatttgcatcaaataccgtttgtcctacagcctcaatcacatgtttaggtacaatttttacaatacctaatcgcaatttaaaaagagaaaacgggtacttcaacttaaattctaccactttatcatctaaagcgttgactgaatcaataaacggaatgaattgtataaatagtgaagcattttttggatctaaaatacgctgataagaatatactatatcctccgtggtaacaggtgtaccatcgtggaaagtcgcaccgtcacgtaatgtaacacgccatgttatatcatcaacttgttcaggttcttttgcagctaaggcgagataaggttcacgggtggcagggtgtaaatccactaatccttcaaaaaagtgcatgttggcagcaaaggaagaggctccactggaagtggacggatcaaaaccggttgataggggataagctattcctgcttcaatgctactacctgttgttgaagtggctttcgccttagaaacaaaactacctaatgtaccgctaaaggcaattcctgcaccgacaccagccaatactttcatgaaattacggcgagattcattttcaatgtaatttgtcatacatgctccttaaaagtctattttgcacacacttattgagattaatacaacgttccttacacttacacagaatattattccctaaaatgaagtaaattaatcacaatataaattaaaatgaattggattaatcataatcgtttagagcaaacagtcaagaatatatgtaaagtaaaatctatgtttgtgaactaggtcacgaaataacggaaatctcaatttgattaaagagctaactactatctaaaagcccctgtcagctatagggaaacttgatgaatataaagtggctaattagccactttgtatttgcatttgatatttaaacagatgttttaaagatgacattattcgctttctgaatatagctattcatttgatcaaaattcatatagcgataggtatcgtctttatcttgttgcaaattttgaacaaaatctaaatattcagatggagtaggtaatttacctaacaatgcagaaacggctgataattctgccgaggcgagatacacatttgctccttgtcctaaacgatttgggaagtttctagttgatgttgaaactaccgtcgcaccatcggcaacacgagcttggtttcccatacaaagagaacaacccggtacttcaattcttaccccacttttaccataaatgctgtaataaccttcgtcactaagcaacttagcatccattttagtagggggagcaagccatagtcttgttggaattgtaccgttaaagcgagctaataatttacctgctgcacggaaatgaccaatattcgtcatgcaagaaccgatgaacacttcatcaattttgtcgccctgaacttcagaaagtaaacgagcatcatcaggatcattcggggcacataaaataggctccttgatttcattgagatcaatttcaataaccgccgcatattcggcatctttatccgcctctaatagttgaggattcattaaccaattttccattgctcgaatacggcgttcaagggtacggacgtcaccatagccttcggcaatcatatatttaagtagaacaatattagattgtaaatattcgataataggttctttagcaagtttaatcgtacaagcagctgcggagcgttcagcagaggcatcggacagttcaaatgcttgctctacctttaattgctccaagccttcgatttctaaaatacggcctgaaaaaatgttctttttacctttcttttctacggtaagcaatccttgtttaatcgcataataaggaatggcatgaaccaagtctcgtaatgtaatccctgcttgcatttcacctttaaaacgcactaaaacactttcaggcatatctaaaggcattacccctgtggctgctgcaaaagcgaccagtccggaacctgccgggaaagagataccgattggaaaacgggtatgagaatctccgccggttcctactgtgtcaggtaataacatacgatttaaccatgaatgaataacaccatcgccaggacgtaaagatacgcctcctcgattcataataaaatcgggtaaggtatgatgagtaaccacatcaacaggttttggataggcggcagtatgacagaaagattgcatcactaaatcagccgaaaaacctaaacaagccaaatctttaagctcatctcgggtcataggtcctgtagtatcctgtgagccaacggaagtcattcgaggttcacaatattgtccgggacgaataccctctacaccgcaagctcgccccaccattttttgtgccaaagtgaaacctttttgattttgcaccgcactttgtggtttggcaaaaacatcgctttcaggcaatcctaatgcaactcttgctttgtgagttaagcctcgcccgataatcaatggaatacgtccaccggcacgaacttcgtctaataacacattagtttttaagctaaattcagctaaaatatcattactgtcatgacgacaaattttgccttcataaggataaacatcgatgacatcgcccatatttaaacggctgacatctacttcaattggcaatgatccggcatcttctagcgtattaaagaaaataggtgcaatttttccccctaacaccacaccgccggcacgtttattcggaatataaggaatatcttcccccataaaccataaaactgagttagtcgcagatttacgtgaagacccagttcccacaacatcgcctacataaaccaacggaaagcctttttgtttcagtgtttctaattgtttgattggaccaatattaccattatcatccggtttaataccttctcgggcattttttaacatagcaagagcatgtaatggaatatcaggacgagaccaagcgtcttgtgctggcgaaagatcatcagtattagtttcaccgctcaccttaaatacggttaaggttaatttttctgcaagttgagggcgagataaaaaccattcagcattagcccaagattgcaaaatctgttgtgcaaaaacgttaccgttttctgctcgttgtgcgacatcatgaaaattatcaaacatcagcaaagtagaagacaacgctttcactgctataggtgctaattcaggattatcaagtgcggtcaataatggctcaatattgtaaccaccttgcatagttcccaaaatttctactgctttgcttggtgaaattaatttacaagttaccgcactttgtgccagtgcggctaaaaaaccggctttaacataagcagcttcatcaacaccggcaggaatacgattctcaaataaatcaagtaggaaatcctcttttcctgtcgggggatttttcaataattcaattaattgagctgtttgctctgcatctaaaggtttagggacgacgccttgtttagctcgttcatcgacatgtttttggtaagtttgtaggaaatcgcacattattcactccattaagattgttgagtagagaaaagagaaagtgcggtcatttttgttaaaaaattgtaatacaaatagaccgaattcatcataatacggaatttatagatgaacaatagaaaaaagacgattattaaaaaataaccgccttttttaaagtagaacacaaaatgtttaaaagacttttttaaatggtttaatgatgactttatcatatacaccggctgcaacataaggatctgtatttgcccattgctccgcttcttctaagctattgaattttgcaataacagttgaaccggtaaaacctgcttctccaggattttcatcatctatagcaggattaggtcccgcagttaataacctatcttcagcttgtaattgttttaaacgttcaaggtgttgttctctgacggataagcgtaatgctaatgtatcaggtttatcttgagcaaaaataacatagtacatcatggtttatttctcctatttattatgagttatttgctgaaatttgtgccaatgctttttctacttccggattattgtctcttggtatggctcgaggtttaccttgtgcatctacggcaacaaaagtgaaaacagcttccgttacacaatagcgttcaccaataggttcgctggcaacctttttgacccatacttcaattttgatttgaacggaagagcggccaatttttacacattccccataacagcaaaccacatcgccgacagcaataggtttgataaatgtcatactgtttacagctactgttacaacacgtccatgagcaatttctttagctaaaatggcacctcctatatccatttttgacataatccaaccgccgaaaatatcgccattcgcattcgtatttgaaggcatagctaaggtacgtaataagagaactcccttcgattgacgacctgtattagtttcaataaatactgacatagattttccttattcttgttctgatttaggtaaataacgataaatataaacaccggttactaatgttgcaatcagtgtcatgccgagaatgccgaaggttttaaaatccacccagatgtcatcagaaagatactggcttatgtaaagattaatcagcatacaaagtaagaaaaagactgcccaacctaaattgaggttatgccaaacataagtgggaagctgaatttctttgcctaataattgttggattaaaggttttttaaaaccatattggctgacaagcaaaatcaaggaaaaaagggcataaacaacggtaaccttccattttaaaaattccaattcattaaaataggcacttagagaaccgaaaaaaactaccgcacttcccataataagttgctgtttctcaatttttccatatttaagttttaaaatcatgagttgaattaacgttgcaataatcagcgtaatggcagcagcttgaataccttgtaatttgtaaacagcaaagaataagatcaatgggataaattctaatagttgtttcattattgtcccctttgttgcataaagagagtgtaaaaacggtaagtgaaaattaatagaaatacgtctgcaagggaaattattgcagtgattaagatttccataaacagattatgactgagaaatagcgaaagctgtcttaataacaaaggcaataggcaattgattaaagtatataagaataacaggtgtgtgcgttttactccgcttttccacattgtttttaaactttgactaatggagtgattatgtatgaggtaatggacattgagtaaattaagacgcacaaacacaaatatacctaatgcgagtgcaaataaagaaaagatagaaggtgatttgtgcatgagagctgaaactagaatttcacttgtaccgatacccaaaggaatagctattaatatattgagtaacaaaagccctccgaaacgtttagttgtcgatataacgctttgagatagttgcggttcgatatgttgactgagttggtgaatggttaatattccccaagcagaaataaacattctcaataaacccgatatgaacaggtaatgactgagttgcaaagtttccgtatttgatattgtttctgatagctcaagcgtgtctgtttgtattgactgtttaaaaaataaagcaaatacagaaacaataaataaaagagcggtaaattgtagcgtgattttttgttgattgcgtacaaagttccaacaatcttgaaatatatgagtaaaattaatcattcaaaaatccataaataaaagcaaacgttacgcattatactgtgtttacagccgaaagtataaaaatccttattacagaccttaagcatactaaagaggagatttaaacttttagtaagctgattgtaacgattttaaaaaaatttttaacaaaattttataaatttgatctagttcacggaaataatacctcttaagtggtattgtacccgctgattgcataaatcggcaatttttattgtgagcaaatattctaatagatgaggaattttctatgaaaaaaacagcattagtacttagcgtggcggctgcattggtggcaggaagtgcaacagcacatgaagcaggcagttttattgttcggggtggtcctattttagttgtgccgaaaacatcaacaaatgatactacgtttaagtttgatgtaaacaaaaatgcccaattggggttgaccggaacctatatgatgacagataacttcggggttgagttattagccgcaacaccgtttcatcataaaatcacgttagaattacattaggtagtgccttagtaggtaaaacaaaacatttaccgccaagcctatatttacaatattatttcttaaacaaagattctaaagcacgtccttatattggtgccggtgtgaactatactaaattctttggtgaaaaagcgataatggagggtgtttccaatcttaaattaaaagattcttggggagcagtatttaacgcaagggtagatattcaattgtccgataatctttatttaaataccgctgtttggtatgcgaaaattaaaacaaaagcaagttttaaaatgaatggtggtgttcaacaacctcaacagaataaagtcgatgtaacccttgacccaatggtatttttcatcggtttaggttggaaattctaagcagagaaaaatattgttgaaggcatgaccaaaaggtgatgcctttatttttttctcaaaatgaccgcacttttatggaaatagcgtataaagtaaaaattaatgttttctctttacatgattttcgttaaaattcggcattcgtccatttttagttattacaacaataatgatcaagcaagctcaattttatattctttctcaacaacaaggaaaaaacggactttttgcggaagaaagtcttacttgcgatcttgccgcctccgcttggcggttggggaaaaaagtattaattacttgtgaaacggaagagcaggcattaaaacttgatgaagctttatggcaaagagatcctgatgaatttgtaccgcataatttatccggtgaaatgacttcatacgtaacgccgatagagatttcttggcaagggaaacgtaatacacaacgacgggatatactgattaatctgcaatctcaattacctgattttattatgagttttaatcagctaattgattttgtgccggttgatgagcagttaaaaattcttgcgagagaacgctataaatcgcttcgttcgcaaggttggcaattacaaacagaaaatatgtaaatttttataaggagtttttttatgaaatctaaaattttggctaccacactcgttggattgctattcggattggttgcttgtgaaaaatcacaagaaagcgtatcaaccgaaaaactggataacaagcagacggagcaagttgaacaaaaacaactggaaagtgcggtggaaaacagcactgaaacacctgtgcaacatgttcaaactgataagatgtcagaaggaatgaaatcaacaaccgaagaagctagcactgattcagcaataaaccaagaaaaattagctgaaaataaagctaaacaggttgaagctaaaaaagtagcggaaaaaaatgaaaccaaaaaagttattgcgattttagaaaaacaataccaaagccttcattgcaccgatggaaataaaagcgaattttgtgtagaagaagcacaacgcttaaaaagtgaaattgaacgactaaaatctcaattgcgtaaatagaaagatgagtagtcgttagatttaagacatctacgctagataatctcttctctctaggcggtaagttagaaaaataacaagccgtagaatggctaatttatgcccagcttcacacggtttctatggggaaagagcggttagatttaagaaaaattttgcaaaaatgaatcataaattagtccaaatcgatcagctaaaaaatcagcttacacaatatcgtccgctttctgaatcagaagtacaacgcttgcgagaagagtttattattgaaagctcatataattccaatgcgattgaaggcaataccattaccctgcgtgaaacagtgctgattttaaaagagggaatgacgattgcggaaaagccattacgagaacatttggatattatcggttttaaagatgcttttaactatatttatgaattggtagcccataatgaaccgttaagcgagcgaaccattaaagatattcattcgcttgttttaatgaataatgctgaaggtcgaggggtttatcgtaaaattccggtgcgaattttaggggcagaaaatgaaccgacagccccttatttaattgctgaagaaatgcagtcattgattgaaaaatatcaacaaaaactgaccgcacttcaccccatagaagcaattagttggttgcatttagcctttgaaagtattcacccgtttattgacggcaacggacgcacagggcgattactgattaattttgaattattaaaacacggctatttgcctgttgatattaaatttactcatcgagcaaactattaccaatgttttgatgatttccataaaaatcagcaagatataagtcgtttggttgagttgattagtcagtatgaagtggctgagttgaacaggtatttggcgattttggaacagaggacataaaatgacaagccgtgaagaattactcaaaaaacaacgagagctagatattctttttaccgcgtggtttgaagaaaagaaaaggcacgaagtgctgacttatcgtcgtgaaaatggggatttgattcagcattatccggacggtacagagaaagtgatcaaatatgctgaaaaaactagcactgctcgtatggcgtaacaagcggttggatttaggcaaaattttgcaatgctttaatcggagggaattgtgatgactaaaccggtaaatgcggaatatatcaaagaaattattgataaaacgaataatcttggctatttggacatccaaggaaaaaccttgcaagaaaaacaagagagttttaaatctttaattcaggaaaaattaaagggatatcacaatgacagtcgaaaagatcattatcaccgaagctaaggttcacgagctttttgttgaaatcagtcaagaattggggtttagtgatgaagatattttacatcattctcaaaacattcttgaattgattgaaatgtggtcagagcaaaaatttgtcgaaatttatcaagaaaatacggatagagtttttggtcgggcaaaagatagtagtcttgcaccaggtgcggttccctattatttaggtatttatcacgccagagtagataaacaaggtgaaaatgatccgttaatcgttttaacatttagatcagaaagagaagataacatcgctgaaattcgctttatggcaacacacgatattttatttggcactgtttccgataaattatttatgcaacgaatgaaagctattcgtcaaagaattgatcttttagtccaaaaagggaattaatttataagggctacacggctacgcatcagcccacacggctcgtgtggggtgacaagcggttaggtttaagaaaaattttgcaaaaaacttctcaaaacagaccgcttgtaaaataacaaggcatttgtctagagaggagtaccatctggaaaataatcaaatatgcagataaaaaataacttaaagtttatggacttctgctcaggtattggcggaggtcgtttagggctagaactaaacggaatggaatgtattgctcacagtgaacttgatcctaaccctgatttaacttatcagctcttttttaatgataaaaataattatggggatttaaccaaaataaatatcaacgatttacctgaatttgatgtaatgcttgcaggtttcccttgccaaactttttcaattgtaggaaaacgcaagggttttgaagatgagcgtgggcagattatttatagcttggtcgatattttagctcttaaacaaattccttattttattttggaaaatgtaaaagggttggttaatcataataaaggagaaaccataaactctattgttaagctgctagaagaaacgggctatgatgtttattatcaggtattagatagtcaattttatggtgtaccacaaatgcgtgagagggtttattttgtgggtattagaaaagatattaaacacaaaccttatcaatttcctgaaatggaagatgccaaacctatttcttattatttaagtgatgaccgtgattatacctttgatgagaaaaatgaaactttccagaagtatttgaataataaatataatcaagggcaaaataaccttactgaaattttgcaaacggattataacgtgattgattggcggcaatctgatttccgactttatcctgaaaaaagcccgacattgagaaccggacgacacggtattttatataccaaaaatggtaaattgagaaaattaagtggttatgaagcattactattacagggatttccaaaagaaattgcacaaaaagttatcgagcataaattacctgacagtaaagttttatcccaagctggaaatgcaatgacggtgacggttattcagaaattagcggctcaattattaaaatcgatagaaagcatatagagaggtgaagatggatttagccaacctaggctcacaaactgcaaaaaatggctttaagaatgaaaaagatattgctgatcgttttaatcattggcaatcacattctgaagctcaagactggttaagaataatgggttatgaattagataaaattgaaaaggttaaagctgttgtattaagtggttataaagcagatattaatgttcaagtatttatcttttttaaagaagctgttgatgttcgtaacattcaagtaaaattagttagtaataaacgaggctttagtcaaatagataaacgctggttaaaaaattatcatgagatgtggcaattcccagcagaaatttaccgcttgttacagcatttttgtggagaactacccccggttattgagaacccaaaagataagcgaagaatgtttatcacagaatttagtgaacaagaacaacgtttaattttagattggttcaagcagagtaaaattttagttttaaccgatattattcgtggtcgaggagatttttcagcagaatgggtattagttgcccaaaaaattaacgataacgctcgttggattttgaaaaatattaatgaggttctacaacattatggtagtggcgaaattaagatttctcgacaaggttcaattaaatttggtcgggttactattcaacgtaaaggtggagatcgtggcagacaaacagccaatatgttgcaatttaaaatagatccaaccgaattatttgagatttgatttcaagctgcccccaaatgcaaaaattaacataagagaaaaaccaatgacaaaacaattcacaatggaagaccgttttaacccttccgccgtagagcaagcactctaccaacactgggaatcgcaaggctattttaagccaagcgaagatgttaatgcaccaagctactgtattgcgattccgccgccgaatgtgaccggttcgctacatatggggcacgctttccagcaaaccttgatggatactttaatccgcttcaaccgtatggagggcaacaacaccctttggcaaacgggaacagatcatgcaggtattgcgactcaaatggtggtggagcgtaaaattgctgcagaagagggcaaaacccgtcacgattatgggcgtgaagcctttatcaacaaaatctgggattggaaagcctattcgggcggtacgatcagccagcaaatgcgtcgcttaggcaactcgattgactgggatcgtgagcgttttacgatggacgaaggtttgtctaatgcggtgaaagaagtatttgttcgcttacacgaagaaggcttgatttaccgtggtaaacgcttggtgaattgggatccgaaactgcacactgccatttctgatcttgaagtcgaaaacaaagagagcaaaggctcgctttggcatttccgctatccgcttgccaacggtgcgaaaaccgctgagggcttagattatttagtggtggcgaccactcgtcctgaaacaatgttgggcgatacagcggttgcggttcaccctgaagatgagcgttatcaatcgctgattggcaaaacggtcgtgctaccgcttgccaaccgtgaaattccgattattgccgatgaatatgtggatcgtgaattcggtacaggcgtggtaaaaattacccctgcacatgactttaacgactacgaagtgggcaaacgtcacggattgccgatggtaaatgtgatgacgctcaatgccgatattcgtgcggaagcagaaattatcggcacagacggaaaaactctcgaaaattacaccgcacttattccacaggactatcaaggcttagagcgttttgcagcacgtaagaaaattgtggctgattttgaggctctcggcttattagaccaaatcaaaccgcacgacttaaaagtcccttacggtgaccgtggtggcgtgccgattgagccgatgctgaccgatcaatggtatgtgagcgtgaaaccgcttgccgaagtcgccaccaaagcggtggaaaacggcgaaatccaattcgtacctaaacagtatgaaaatctttacttctcttggatgcgtgatattcaagattggtgtatttctcgtcaactttggtggggacatcgtattccggcttggtatgacgagcaaggcaatgtctatgttgctcgagatgaagcggaagtgcggtcaaaatacagcttaactgcagacgtagcgttaaaacaggatgaagacgtattagacacttggttctcgtccggattatggacattctcaacacttggctggcctgagcaaaccaaagaactgaaaatgtttcacccgaccgatgtattaatcaccggttttgacatcatcttcttttgggtagcaagaatgattatgttcacgatgcacttcatcaaagatgaaaacggcaaaccgcaagtgccgttcaaaactgtgtatgtaacgggcttaatccgtgatgaacaagggcaaaaaatgtcgaaatcaaaagggaacgtgttagacccgattgatatgattgatggtatcagtcttgaggatttgcttgaaaaacgcaccggcaatatgatgcaaccgcaacttgccgagaaaattgccaaagccactcgtaaagaatttgaacatggcatttctgcacatggaacggatgcgttacgctttacccttgcggcgttagcgagcaatggacgtgatatcaattgggatatgaaacgtttggagggctaccgcaatttctgtaataaattatggaatgctagtcgttatgtattaacccacgaaaaattggatttaagtgagggcgaagcggaatattcgttggcggatcgttggattgagagtcaattcaaccgcactatagacgcatttcgcaccgcacttaagcaataccgtttcgatttagtggcaaatacgatttacgattttacttggaatcagttctgcgattggtatttagagctaaccaagcctgtatttgctcatggtacggatgctcaaaaacgtggtacaagtcgcatgcttctcaatatattagagaaattattgcgtttagcacatccaattattccatttatcacggaagaaatttggcagaaattgaagggtgtaatgaagttatcaggcgataccattatgttacaaccatttccacacatagaggaaaatcggcttgatctagaagcggaaagccaaatgaattggttaaaagaagtgattgtagcggtgcgtaatattcgtgcggaatgcaatatttcaccgagtcatgcgttggaactgttgctgagaaacatttcagaggaaacaaaaatttgccttgaaaataaccgcactttattacaatctatggcaaaattgtctacgattactttactggacgtcaatgaagaaccgccactttcggtcacgaaactggttgaaaataatgaaatttttattccaatggcaggttttattaataaagagcaagaactcacaagattgactaaagaaattgaaaaattgaaaggtgaaattgttcgaattgaaaacaaactcagcaatgaagcctttattaccaaagcaccggagcaagttatcgccaaagagcgggaaaaaatgcaggggtattcggataatatagaaaaacttcaacaacaatatcaggcgattgagacgttgtaagtatttaggtcgatatttgatctcccgccgtcaaatggcggtcgggagatcgatgttaatcgtggtgaaaatctatcttaggttctcccaagaataacggaccgagtggatttttaggcaaattgaagtgattaggatacttcacctctaccaaatataaaccatcaggtttagcagttggtgcggctaaagtgcggtctttttgagttaaaagccaatccatccattcaaccggctgttttccgcttccaatttctaaaagactgccaacaatattgcgtaccatatgatgcacaaaagcgttagcctgaatatccacaataatgtaattggcttggcgaaaaacatggagatgatgaatatttcgccatggtgtattagactggcattgtgcggcacgaaatgaagaaaaatcatgttcccccaataaatattgccctgcttggtgcattaaacgatgatccaatgcaacgtgatgatgagtaactccagtgggaaaaagagcggaacgtagcggatgattataaattaaataacgataacgccttgctgtggcactgaaacgagcatgaaaatcctcactgacgacctttgcccaacgtaccgcaatatcagcaggtaaattggcattaagaccgaatgtccatgctttttcagagcgaatcgctttcgtgtcaaaatgtaccacttgaccggtagcatgaacacccgaatccgttctacccgcacaatatatttgacaaaattcatttgcaacaaaactgaccgcactttccagtttttcctgtacacttgtgacattcgcttgacgttgccaaccgaaataatgtgtaccgttatattcaatacctaatgctattttcatattatgttatctgttaagctgaaacccattttatgatacttgaatatagtcgagcggtatatcacctaaatacgccaatagttcttctgtcataccacgatatgacaacctgaaaggttgttcaaccaataccgctcgagcaatattttccacttcatttccatttaaaagtaaataattcaatgctgtttgtagtggcggtaaagagggattaaatgcggcattttcagcataactgccttgaaaaatctgttgatcttgcaattgcaatgcaatacctgaataggttttggaataaggggcatgagattgattagcagcatcaagtgcggcttgaattaacggatcttccgttatcaaaaataaattatgtgcttttttatcaaatagacgattatctatctgtaaattatggggtccaaaagcatccggcaaatagtgatgtaataaattatcctgactatgtggcaaatgaatgcgtaatgtttccgcactgttaagttcattcataaattggcgacaatgtccacaaggtgtgtaattgacggtaatctccgttattttactttcacgacgcatccaagcatgagaaattgcactttgctccgcatgaacggtttgctgaatgttcgtggtacaaaattcttgattagcaccaaaataaaagttgcctgactctcctttagcaattgcccccacactgaaatgggagattgtgggattagcataacacgcactgacgggtagtaatattaaagccaattctttgtccgtcatatgatatttttcgcaaaaatggtttactgtgaatgcgggtagaaagccctgaaaattctgttcgcctaagatataccacagatcctgagccaaatttctgttttcaatttgatttaaagcctgtttaatccgatcagatatatgttttaatggatgatgtgtcatcataaatccttgttgaatattgagattgggttgaatgtgccaaacatttaaaataacgtcaagtagatgttttaattgtatcttattatttttggctgaaaaatttctaattataacaagttaaacacttttaatatttcatcaaaaatataattttctgcattgaaatagttactcttttttaaacgacatagcataactcgccataaaattggatctttaatttttacgctgactaaatgaggatcgggataatagtacgctgtagataggggtagaatagtcaaaatatctgaattagattttgcagtgtaatataaaaaatcccaacaggctgattcatagatgatattagggtaaatattatgtcgttcaaatgcttctttcaactgttgataaatcataaacgttttatcaaagatgacaattttctctttatgtaattcctgccaagtcacactttctttttgagcaaaatgatgttccggagagcaaaataccgagagttctgagcgataaatttcgaaagattcaataatcttagatgaaatatgttcaggatagagcaaggttgcaaaattgacattacctagtaatagttcaccttttaatgaatatgcaccttgttcttttacttcaaattcaatttgaggattatttataatcagttccggcaaaattttagaaaaaatcaaagataaaattaaaggtggaataccgatagatattcgccctgtcatttcttgttctttcttatgtagatttttgttcatttgattgtatttcttgagtaattctttagcatcacggtagtagttttctccaacgtaagttaaccctctaatttttccattagctcgtgtaaataatgcaatattttcttgatgctcaaattcattaatcatcatacttaatgccggttgagaaatataaagattttgagatgtccgacttaaattgaagccgttttctacaattccaataaaataacgtaaatgtttgatatccatgatttctccttaaccaattttgtgttcagccgttctataagctgtgtttcttttgtattctttatatgtatctacattctataagattaatttataggtatgtaaaaaaactgtattttgaattattcgaacaaattactacacttacctcaaataaggtaagaatactagattatctagattttataagtatgcttgcttagtttttttgggatgtattgagcgttttactctctcaatgtataacaaaaatttaaccttaaatataaatttattttatctcataggaagatgctatgtctaaatttatttcaattgatgagctcaaatctcatttttttgatggaatgacaatgatgtccggtggtttcatggggtgcggtgctcccgaactgatcattaaagaaatcttagaggcaaacattaaggacattactctaatcagtactgacaccgcaatggtagatactggggtaggtcctttaattgttaatgggagaataaaaaaactatatgcctcacatatcggaacaaattctgaaactggtaagaaaatgatttccggtgaattaaatgttgaactttgtccacaaggtactttagcagagcgtattcgtgcaggcggagcaggattaggcggatttttaacgccgacaggggttggcacagtagtagaaaaaggtaaacagaaaatcactattgatggtgtggaatatttactggaactaccgttaaaagcagatattgcaattattaaagcggatattgccgatgagattggtaacttagtttttttaggtgcagctcgtaattttaatccaatcatggctctcgctgccaacacagtcattgtacaagcaacaaaaatcgtgaaagtaggtgaaatggatccaaatttagtgatgacccccgcagcagtggttgattatattgtaaaagcgtaacggaaggagaaaaaacaatgaatgctaaagaaattattgctcgccgtattgccttagaattaaaagatggtgatgttgttaatcttggtattggtttgccaactatggtagcaaattatatcccaagtgatatttcaatcactctacagtctgaaaatggctttttaggtttgaccgcttttgatcctgaaaatcccgatgaaaatattgtgaatgccggtggtcaactttgctcaatccaagcaggaggtatgttctttgatagtgcttattcatttgctttgattcgtggcggtcacgttgatgcttgtgtactgggcggtttagaggtcgatcaagaggcaaacctagcaaactggatggtgccgggaaaaatggtacctggtatgggaggcgctatggatctagttactggtgctcgtagagtaattataggtatggagcattgtgcaaagacgggaacctcaaaaatactaaaaaaatgcactttgccactaaccgcacgtaataaagttcatctagtcgtgactgagcttgccgtatttgaatttatcaatggacaattaaccttaactgaaatggcggaaggttatgatttggatatgattaaagctaaaactgaagctgaatttgtcgtttcgccaaatctaaaaacaatgtcgttggcaggtgcataaggagcttattatgattagccgtatttctcggtttatgacaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataaaaataaggaagcaactatgaaaaatgtcgttattgccagtgcggtgcgtaccgcaattggaaattttggcggttcacttgcagacacctctgctgtggaactcggtacagctgtaatcaaatctgcgattgaacgagcaggtattgatataactgctattgatgaagtaattatgggaaatgttttacaggcaggtcttggacaaaatcctgctcgtcaggcactattatgttccggcattgctcaagatgtaccagcttatactgtcaataaagtctgcggttcaggcttaaaagcagtagttctaggcactcaagcaattaaagctggtgatgctaaggttatcatcgcaggtggtatggaaaacatgagccaagcaccttatcttcttgaatccaaatctcgttggggctaccgattaggagatgcaaaagtacaagatgtgattttatctgatggtttgatttgtgctacaaaccactatcatatgggtatcacggctgaaaatatcgctaaaaaatatgatattacccgccaaatgcaagatgaattagcacttgcctctcaacaaaaagccaccgctgcgattcaatccggtgcattcaaaaatgaaattgtaccgttaaatatcaaaattaaacgcaaagaggtcattttcgacactgatgaatttgtcaaacaagattcaaccgctgaaggtttagcaaggcttcgtgccgcatttgataaagagggtagtgtaactgccggtaatgcgtcaggtattaacgatggtgcggcggcattagttattgttgaagaagaaacggcaaaagcattagggttgaatattcttgctcgtatcaaaggttatgcaagtggtggcgtatcaccagatattatgggaataggacctgttcctgctactttaaatgctttgaaaaaaacaggtttgcagttaagcgatatagacttaatcgaagctaatgaagcttttgcggcacaatttttagctgtaggtaaagagttagggtttaatcccgaaaaagttaatgtcaatggtggagctattgctcttggtcatccaataggtgcaagcggagcacgtattctagtcactcttttacacgcaatgcaggctcgtgataagcagttgggtttggcaactttatgtattggtggtggtcaaggcattgcaatgattgtggaacgtatttaataccaactggaaaaaaaggaaaatattatggttaaaaaagtagctttaattacaggtgcagcaagtggtattggtttggcaatatgtgagagccttgcaaccgaagatttaaatatagtgatggtggatgtaaataaagagacattaaaagaacattccactcgtttaggaacggcttatattcaagcagatctttcgaaacgtgaaggttgtaaaactgcggtagattttgcagccgaaaaatttggtagcgtagatattttggtaaatgtagcaggtatccaaaatgtagccgccattgaaaatttttccgaagataaatgggattttatgattaacttaatgcttactgcaccatttttgcttactaaatacagttggaaatacatgaaagcaaataaatggggacgtatcattaatttgaattcaatccacggtttagttgcatctgatttcaaatctgcgtatgtttcagcaaaacacggtttatcgggcttaactaaagtagctgcattggagggtggtgaatttggtattactgttaattctatctgtcctgcttatgttcgtacaccgttggttgataaacagatcgtagatcaagctcgtaatcatggaatttccgaagatgaagttattagcaaaatcatgctttctaaagctgctgttaaacgcatgattgaaccttcagaactcggcgaatttgtcaaatttctctgttctgattcagcagcatcaatctctggagcttgcttaacaatggatggtggttggactgctgcctaaaaatttatggaactggggaaattaatggaaataatcccccgagtttctctttaacttaagaggaaatatcatgagtactatcgcaattattctttcattattgatgctgatgtacttcgcatacagaggtatgacagttttattattagctcccttactggctgcttttgctgtcttactaagcggtgatggatcaatgatgatgccaaaatatacagaaacttttatgtctgcattaagtggctatttacttaattttttccctgtgtttctatttggggcattattcggtcagttaatggcagattcaggtgctgcaacaggtattgccaaaggtattgttaaaatgttaggaagtcggcaggcaattcttacagtgatcatcgcttgcggtcttttaacttatggaggcgtgtctctttttgtagtagcatttgcgatctatccgatttcaaaagtgctatttcgtgaagcgaatattcctaaacgtttgattccggcaacgattgccctaggttcatttactttctcaatgacggcattaccggggacaccggctgcaaccaacgcaattccaattcctttttttaatactaacgcatttgccgctccgggattgggtttaattggtgccatgatcatgttgataggtggttggttatggttacaaagtcgtgctaaaaaagcagcttctttaggtgagggttatggtaaacacgatagtgaatcaagtgcggatttagctatattcgagaaaaatgtaatgccatttagtttatcactacttcccttagttcttgttatcgccatgaatgcaatttttacttatactttttccaatatggactttagctcattgcaagaggtctttccaaatctcaacattaaaggcaagactggattatgggcaatcatcgcctcattattaattgcatgtgtagtattagtatttttacgtcttggtaaatggacatcattacaagaaactatcaataaaggtgtatatggttcaatgttacctatttttaatacggcttcagaagtaggttatggagcagtagttgcttcattagccggattcgctattattcgagattcagtgctaaatgtatcaactaatccattaatttctgaggctgttgcaatgagtgcgcttgctggtattacaggctcatcatcaggaggattaagtattgcaatgagaacgcttggagcagactacctacgtatgggaattgaggcaggtattgatccggatttattgcatcgagtagcagtaatggcagcaggtggatttgatactttacctcattgcggtgcaataattactttactttctatctgtcacttgaatcataagcaatcttacttgaatattgcggctgttaccattgcaataccaatagtagccgtcattagtgtgattgcattaggcacagtgtttggttcattttaagtacaaataagtcgaaaaatggaaagcttatcctgcaagtagttaaattttaaaaatttcttataggaaatgtagcaaaaacagaaagtgaaatacttatggaactgttacacgatatcaacaaaattaacccacttaaaaaagtgggttaaatttaataaaaaggtttatttcaagcaactaaaatagctatctgcggtatattgtaagaaattggcataggaatttttacctaatttaactttgtcacccatcggatccaagcgtccaacgtttacacctgttgctttacctaaactttcaattacttttggtgtaaattgcggttctgcgaacaagcaatttactttatgttcagtaatttcttccttaattttagctaatgtttttgcccctggtgcaactaatgggttaatagtgaaatagcctacttgatttaatccataagcgttattgaaatagctataagcatcatggaaaacataaaatcctttttcttttactgaagctaattgctttttaatttcgttattttttgctgctaaagtgcggttaaattcagcaagatttttttcaatcaatgcttttttggccggatattgtattgacaacttctctgctactttttgtgcaacaattttgctaatttccggtgagtaccaaacatgccaattaatgcccaattcatcatgttcatgattgtgtccatgcttgtgttcatggtcatgtttgtggtcgtgatcgtggtcatggtcgtggtcgtggtcatggtcgtggtcgtggtcatggtcatggtcatggtcatggtcatggtcatggtcgtggtcatggtcatggtcgtggtcatggtcatggtcatggtcatggtcrtggtcntggtcgtggtcgtggtcgtggtcrtggtcgtggtcatggtcgtggtcatggtcatggtcatggtcatggtcatggtcatggtcatggtcgtgatcatgatgatggcctgtcattaaaagtcctttagtattaatttctgaaatttcagcaatggtaactacttttttcggatctataccacgtaaagttgcatgatctaaaaacgcatccacatcttcgccaatccaaacaactaaatctgctttttttagtttttgaatatcggaagggcggaaactatagtcatgcggagaagcacctggtggaacaataacttgggtatcagttacaccatcagcaatagatgaagcgataaaacctaaaggtttaattgatgttactatgctagcatttgccacagcagataaagaaaaaagtgctgtactaattaatgcttttttaaaggtaaaattagacattggaatactccttttcatgattaataacgattttaaaagacggactaggttatcactttttcatcaaattactagaatttttacaaaactttttagcctttggctaatttatttattatttttgctactgcaaaaaagccaaaagtcgctgttatcattgttgctgcaccaaagccattggcacaattcatggtagctgaagtagtacaattatcagccatttttggaaaaattaaaggctgagtggaaaagacacaatcgactacaaacttacgtttaggattttgcggaaaatgatattctttacgtaaaaccgaccgcacttttgccagtaaggggtcttgaatagagcgactaagatctgctactcgaatttgacttggatcggtttgtcctcctgcaccaccaattgtgataatcggaattttattgcgtttacagtgagcaattagtgctgcttttactctgacattgtcaatagcatcaatcacataatcgtagcctgtatgaatatattcagctaaattttcagcaagtaaaaaatcatcaataatattcacgtggcaatccggattaattaattgcacacgttctttcatcacttctgtttttaacttgccgatattacctgttagagcgggtaattgtcggttaatattagttacacagatgtcatccatatcaatcatggtaatttgcccaataccgcaacgtgcaattgcttcgacaacccatgaacctaccccaccaatgccaatcacacaaatatgtgtttgctttaagcgttccaaaacgtctattccatatagtcgtccaattccaccaaagcgttgttcataattatcaatacgttctgtcattattgtaataaccacactctaccatagtgcttcgataaacccgcaatatgtccggcattatcgccaattccacgatataaatcaaaatgctgcccttttactgctcctccaacatctaatgccaccattaaatgtaaaatatgttcaccggtccaattgccttcatcatcaattttcggtacttccactaaaactacagagccgcttgggatcacatttttatcgctagcaatagcagccataggtactaaaggcacaccggcagaaccaagcacttttccgttaggatcttttttgaaaaaaacataagaaggattacgttctaacaaggcttgtaagcgtgatggattttccattgcccaatttttaatggcttgaatagacattttttctttggaaatttcgccatcctctaccagcaatcgtcctattgctacataatcaaaaccattttgtcctgcataggcaaaataggtcaaatctccgtgaccaaaatcaacataaccgctaccttgtacgccaagtagaaaattatcaatcattgaatcagtgtaagccagctcaagtcccttaccttgcaaggcaccggcataaatttgagctcgagaaaaacgtttattagcaggcaaagcataaataggttgattatatttgccctgttgcgtatgacgagcatgaataaccggcgaataatatcctgtcattaatacattttggtatccgtcggttcctttcataatttgagcttgaataccatagtctgctaattgtttagtattcgcacccgccaatacccaatgagttactttgtcataaatgttcgcaaattgattagctaagccagttgatgcttgacgaatattagtaagttgcgttaaaaaatcaccttgattgatgaccgcacttttgttgtcaacagaggaaaccggcactaatgacgcttgctgataactacgcccagcatattttgccccgaattgtttcgcatcattttggctagctgttttagagtgttcggaagaacatgcaaccaaaatagcgaccgaaaataaaatactttgtttaactactgttttgataaaaaataccatatgttaccgaaaaaccgcataattagagacgtcttaaattagcaaaaaaactgtggaatatacagtcttttatcattcaatgaagataaaaaatttacaattcgcttcattttatcattggttgttttgttatttacactgatgcaaaatgtttttacgcttgaaccgtcaaataaaagcgcggtgttaatttagactactttgagtattgcaacgtcagggcttgattttgcagtccaagccctcaaaattatttaaaactcaccgcacttttaggcttcattaattccccaaagccaagccgccccacgcacaccactggaatcgccgtgtacggcttttttgatttcagtaaaaaattctctaccgaaaatataatcgttcatccgtgtcggtaaggttgtgtacagacgatcaatgttacaaacaccgcccgccagtacaatcacatcaggatctaaaatatttacataagctgctagagcttttgccaaacggcgttcataagcttgtaaagattgttcggcagtaggatcgccttgctcggcaagtgtggcaatttcgttgccttttaatcttatcccactccgacgttcgtaatcatcacatagaccggtaccggaaacaaattgttcgatacaacgatgtttgccacaataacattgtacgttatgcgaacgttcttcttcatcttgccaaggtaattcgttgtgtccccattcaccgccgataccgttagccccattccaaggttttccgtcaatcacgataccggaaccgcaacctgttccgagaataagtgccaatacgaccttttttcctgctcctgcaccatctgtggcttcagagacggtcatgcagttagcatcattggtaattcttacttctcgtcctaaaagtgcggtcaagtctttgtctaaattttgtccgttaagccaaacagaattagcatttttgactttgccggtaaaaggggaaatagtgccgggaattccgatccctactgtgcctcgttgccccgttgcatgttccgcatcatctaccaaacttttaattgctgtcaacgtgtccggatacgaccctctcggggtaggaatacgtttgcgaaacaactcttcaccgctgttacttaacgcaataacttcaatcttggttccacctaaatcaatacctatacgcataaaaaactcctataaatgaaatatgaatattgtgatccttgtaacattattttattttgatattttatatactttcctcctttaaaattattatcaggtattaatgtccaccagcatatcaattttagtcattgatgacgatattcaaatttgcgagctactcaccgatacttttgaagaatatgggtatagggttgttgcagtctcttccggtcaggaagcattaaccttattacaaaccaattctcgctttgatttgattttattagaccttattctccccgatattaacggactggttttgcttcaacaattaaaaaatctgttgaataagcccatcattatgttgagtggcttaaatagcgaatccgatgtagttgttggtttggaaatgggggctgatgattatattaccaagcctttttatcctcgaattgtagtggcgagagctaaagctgctattcgtcgcactcaaccacaagccacaaccaccgtttatacgcatagcggttttttgtttcatcaatggtatttagataccgaaacacataaactttattcgccccaaaaacaggaaattgaactgactcacggcgaatatttattattgtatgccttagtttctcacgctcaaaaagtgttgagccgtcaaaaattattagaattaacccatgcagaaaatttggaaatttttgaccgcactattgatgtattaattatgcgactacgtaaaaaaattgaaccgaatgttaaggctccgagttttattcagactgttcgaggcctagggtattgctttgaggcttcagttgaaaaactgggagaaaattaagtacgctattatgcaactcaaatcctcactttttaagtattctgcattgtttctttggtacgaataaaatcctttaatttcacatagctgactgcaccttcagtagcagagagtgaaaataaattgaaatacgccaaaccgtgtcctaattgtaaggttttttgtaacggtaaattctgatgtaatccgtataaaataccactacagaaagcatctccagcccccaatgtactcagaattttatctttttcgacccagtaggaaggaaccgtaacaatatttcccagcaaatcacaagcaaccgcatatttaggtgaatgtacaataacggctttctttacacccagttgcataatcgcttttgccgtcgtaaccaactctttttctgtagaagctatatttacttgttccgttaaaattttggcttccacatcattaataatcacaaagtccacataggataagatcgggcgaataacatttttaaaaatctgtttattttcacaggaaaccaaatcaatcgaaataagaaaacccttttcttttagcactgtcaatgtttttaccagttttgagacatccagcaacgccggcagtaagggcaaataagcgatatgggcaattttagcattacaatctatcgaggtaacagtttgatgatcatattgctgcattgctcctatgtaatgaaaaaaagtccgctctccgttttgactgttaatcattacatcagtaaaggaagtggggagatcgctttctaacattgcggttaataccacattgtgtttcttagcttgccgtaaaataaattgtccttcactatcttttccaatagcaccacttaaaaataaagagagctcgggatccaatttagataaattgaataacacattagtacagccacccccacagtgtaatcccatttccgaaatagttgccaacatcgtttctttgggataatcggagatcactaaagttcgatctaccaataagtttcccaacgccaaaatacccttacgtttttgcataatatctagctttatcgatgctgttaaaaattttcaattgttcggcaacggtttgactaatcgcatgttgcatattattcattatcatcaagtattgattatatttgccacttaattctatggatctcatatccaccgctaaggtatctaatgccgtttgagacatgccggtaaagaaattgattttgcaaatacccaattcaatagttttacggaaatcttctgcactaattcctgaaccaccatgtaataccaaaggaacatcaacagcttgattgatttgtgcaaggcgttcaaaatcaagcttaggttcgcctttatatttcccgtgcgtattaccaatcgcaactgctagagtatcaataccggttttttctacaaattccttggcttgttccactttggtataaagtgctacatctgctatactttctaacgcaccgccttcatcgccacccacggcacctaattcaccttccacagaaatattataagggcgacataattccactatttctctagtttgacgaatattttcttcataagataaagaagaaccatcaaacataatagaggagaagccacattcaatggcttgtttgacggttggtaaagttaaaccatgatcgaggtttaaacaaactgggatacttgctaattgagctttctttttaatgtatttggcggtcgcaggtaaatcgatatattgcaaatgtacttccgcgacattaataatcaccggtgattgctgctgtttagccgcagcaaatactgcatcaataaaattggaatcaattgcattaaatgctcccacggcaaatttatgttgtaccgcaacggtcagcatttcttttaaattaattaacgacataaaaattccttataatcactacaaagtaaacggataggttgttcattttcctgaatggttgaaaaacgtccaagagattctaaaaaacggttatcggtgagatcatcatttgtcattgatacctcaccaactaaaacatcgctatcttccgcccaaaagctgtggtagagcattggtggtaagcaaatactttggcctgggctaagacgaattttgctacctgcggcaacttgatattgttccccgtctatttgaatatcaatggacgaaaccttatctagcagctccgttatttcatcacgcctgtataactgaatgactaaaatgccaccgccacgatttataatatcttccatttttttccaatggtagtgcattggcgtaatttggttttgcttcaccaacataattttttcggcataaggtttattgtttctatccgactgattacgcaaggtaaatagggtcaatcccgcctgtttgaaattacctaaattaaaatccgtcacatcccagcccaaatttgcttctagtatttcagcatagcgttccagagaaagtgtatgccaatccgctagtgaaaaatccgcaaatttcggcagtacaaagtggtattttgccatcatttgctgtgcttctctgatcgcttgattaatttccgaacgcttcatattttatttcctgtcatcaaaacaatgaaaaaatctaccgcactttttagctgttgataatatgttaaagccgttgcacaaagggaacggcttggtttttctataattattttacagtccaacctttgtaatctttgatgttatcgcgattaattaaggttacaggaatcaagaccggtttttctggtgcggctttaccttgtaaaatatcgtaaccgatttctaccgctttcgctgccataacttgcggatcttgtgccggtgtgccgttaaacaagctattgctttgttttaatgcatcttcaccgtctggagaaccatctacacccatgataaaaaattctttacgttgtgcctgtttcgccgctaagtcggcaccgattgctgtcggatcattaattgcaaatactgcatcaattttcgggtgagcgattaataaggaagtcattacttctaaaccaccttcacgactgccttttgcattttgattgtgagacaataatttgatccctttatgcttagccaatacatccatacaaccttgaacacggtcttgtaccgcagaaactggtggaccgttgatgataaccacattacctttaccatttaatttatcggtaatggtttgacatgcaatttcacccgcttggtagttattggaagtgacggttgcatttgcaccatctgccgctacatctactgccacaacaacgattccggcttttttcgcacgctctactgcaggtcctatacctttagaatctgcagcatttaaaatgatcatatcggttttcgctgcaatgaagttgtcaatttgtgctacttgttgacctaaatcgtagccactggacacggatgtcacattcactttatcgccagctagttcttttgcttttaactcagcacctttggcaatttgcacgaaaaaaggattggccaaatcaccgactgttacaccgatagatttaagttctttggcttgagccaaaggagccatggccaacataacacttactgctaatgtttttaatttcataaaatatctcctatgagattatggttaaggaaaagtttgagtaatttacccaaattagtttgctttactggtacgatacttatcgatgagtactgctacgataattacgccacctttaatgacaagttgccagaaataagatacccccattaatgtcataccgttattgagagttgcaatgatcaatgcaccgattaatgtgcctgtaattgtaccgataccgccaacgaaactggttccgcctaaaataaccgcagcaatagcatctaattcatagccaacccctaagttaccgttagcactatataaacgagaagcactcatcacaccacccaaaccggataataaaccgctggtagcatacacaaaaatcaacactagagatactttgataccagttaaatgggcagcctgtaaattcccaccaaccgcataaatatgtgtacctaacgttgtgcgacgtaaaataaaccaacataccgcaattactgcaaaggcaataatgactaaccaaggaatagagcctagataaccgttaccgatccagtcaaaagaaatttttgagttaatcactgttgtgccgtcagccactaagtaagcagcaccacgaagtgcggtataagttccaagcgttacaataaatggtggcaatcctgcataagcaaccaataaaccattaaaaacacccatacctaaacctgcaactagagcaatcggtactgcaaaatcggcaagtgcaggatttaacgaacacaccaatgccatgacggcagttactcctaaaattgaccctacggataaatcaattccaccggttaaaatgatgaaagtcattcctgctgccaagacgatattaattgatgcctgacgggcaatattcatcatattggcttcactcataaaattgggggcaataaaggaaaagacgataataatcagtagcaagataggtaaaatacccattgcttggaacatatccgataatgcctgttttttagctcctgattttgctacattttccatattaagctccttacatctaaatttacgctgcaccacaggccaatgccataatgctttcttgattaatttgttcacctagaacttcaccgacaacatagccttcccgcattacataaacacgatcgctcataccgacaatttcaggtaattcactggaaatcattaaaatcgctacaccttgttttgccatttcaatcatcattttataaatctcactttttgcaccaacatccacacctcgtgtcggttcatctaaaatgaataacttcggatgaattcccatccaacgggacaacaatactttttgttgattaccgccggatagtccactcacatcgacattagcattcggcactcggatttttaaacttttaattgcctgatcagtatccgcttttccttttgtctgattaatcaccatcatggtggcatcacgttcaatggtcgcaatagttatgtttttaaatacgttcatatcaaggaataatccttcttctttacgattttccggtaataatgctacgtgatgaataatggcttctcgaggtgagctgaaactaatttcggcaccgtttaaatacattttgccttgtgtaggtcgactaacaccaaataataaatgagctaattcagaacgacctgcaccaaccaaaccggataagccaataatttcacctgctcttacaactaaagaagcattttttattttattaccgtcagaaagattttcaatgcgaatgacttcctcgcctattggtactttttctttattaaacaaatctgttagtggtcgtcctaccatcatttgtactaaagtgttggcatgcaaattctcacgtagtaaagatccaacatactttccgtcacgtaatacactcacacgatccgccaattcgtaaatttccgccattcggtgactaatatagataattgccaatccttccgaccgtaattttttgatcaactcaaacaatttttctgtttcacgggaggataatgcagcagtcggctcatccatcactaaaattcgacttttacgatgtaacgcgcgggcaatttctacttgctgttgctcagcaatggtgagagaggacactttttgataggcgaaaaattgagcacctaaacggtctaatacttcctgtgcttcttcttccattttcttgcgattcaagccaaataccgtaccgatttcacgacctaaaaaaatattttctgcaactgtcaaattcggtgaaagatgaatttcttgataaattaaagtaattcccgcaagaatggcatctttcggcgaagaaatcggaaagagtttgccgtcaatgttgatttcaccggaagtagcaatatacgcacctgccaaaattttcattaatgtacttttaccggcaccattttcacccattaacgcatgaatttcaccacgatatacatctaaatcaacatcttgcaatgcataaaaatcgccgaaacgtttggcgatatgacgcatttccaacaacggtgttacggaaatattgacagcctgctccattttaattgccctcaatctttattttgatttacagtaaagcataagtttatgaacagaacatgttaaaaactcattcatatttgtcataattccataatagaaactatttataatgtcacactcggtcaaaagtgcggtaaaaattacaaaagttttattcagtcggtagttatatgttaaaaaaacttttttctactcattcctacggtgttagattacgattgatcgtattcgtactggtggcagtttttctgattttttcaattagtgtgatgtctgtatttggattgaattccagtcataacgccctgtcaaatttacgtgatcgctccatgaaccaaatgtttttctccatgagtttaggtatcaaaaccactcagatttccacttatgccaataaactcaggcagacctttcgtgcattagaatatcaggaagcgtccaagcaactggcacagcatattgagcaagtacatcattatttggatcaaggcaaaaaatacgccagtccgttagagcaacatcaattttcagggattattcaatctattgacttattggaaaaaagtgtgcaagagctgttacaacaagcctatcaacgccatgttttgaataccagcatcatcagcaaattaaaccaatccttactttatttagaacacattaaaaggttagaaaaacgcaccgcacttttagcagacggcaaactgtttgtttctgactttcaacaaattgaaaacttgattgaaactgcgactaaaggtttattttcacctgaaacctttattgccattcgctcagtattttcatttttacccgagaaaaaacagccagatattcagcaagaatggataaaaatagaaaatgaatttgaacttatcactaaatcagcctaccaattggtagcgattaatcaacgtattcaattcttaacttatcaaattgattcgcttgtagctcaaattgaccgagattacagccgtttggcacaagaaaaaatcgctattgtgaatagtgaatctgcaaaaattcaaaccgcactttccaagcatattttgtatatttggggagcttctttattcacagtcggcttgattatcattttgggtatttatatttatcgcttattcggtaagcgtttgtattctattactcaggcgatgactcgcttatcacaaggggataaatatgctcaagtaccgcaacaacaacgacaagatgaaatcggcgaattagctcgagctttttatatttttcagcaaaatgtggtgaaactagcacgtaccgatgccttattgaaagaaaaaagtgaattgttggagcgaacttttttggcaatgcgggacggtttggcgatttttaatccctccggttgtttaatgtcttgcaatagccaatttatacaattattacattggcatgaagagcaagcacgagaggctaatttttcaagtctagcgttctttttacagcaaggttcagcaaaaatttatggtagctcggagcaaattaatgaaaaattattaagtgaaatgcgtagtgagcaagaaccattggaaatcgactattgccggcaaattttggaatggagggtaagtgccttacaagacggtggtttggtggcgtttttaattgatcgtactcaacgtaaaaaattggaaacggatttagcacacagtcaaaaaatgcgaagtatcggtcatttaaccggtggaattgctcacgatttcaataatttattggcggtgattattggtaatttagatttgatagatcctgaaactttacacgacaaacaggcaaaacgtttgcaacgtgcattaaaagcggcagaaaatagtgcaacattaacacagcgtttgctggcttatgcccgcaagcaacctctccatccgacctcattagatttaaaccagctattatttgaattttccgattttatgaaacatagcctgccagcaacgattacagtgcggttagatttagcggagaatttaccgctgatttatatggataaaaatcaattggaaacagccttggtgaatttattggtgaatgccaaagatgccttagagagtaaaggcgaaattgtgctgaaaacccgtcaattattagtccaacgaacccataaaaccgaacaaatggtgcaactgtcaattattgataacggttgcggaatgagtgaagaaactcgtcgccatatttttgaacctttttttaccaccaaacaaaacggtaaaggtagcggtttgggattgtcgatggtatatggatttattcgccaatctaaaggaagggttaaagtacaatccgaactgggtaaaggcactaagatccatttacagctacctatttcccgcagaaattcaacaatttccaccgcacttccagcgagtatggatttatctgaacgagcgacattaatacttatcgaagatcaaaaagatcttcgggaaaccttaaatgaacaacttatcgcaatgggctatcaaactctcgtatttgaaaatgcggaacaagcaatgtcgcatttatcgaaaaacgaacgcatagaatatgaatatctgttatccgatgtggttttgaacggcaaaatgagcggtattgatttagcaaattatataaaataccgttttcccttaatcaaaatactgctaatgacagggaaccatacggaatacatcgctcagttcagtgagtttgaggtgttaaataagcctttcaaacaagaagaattattggttcgtttgaaatctttatgataaagaagactgtagcaaattcctgtaattaaagtgcggttgaaagtttttctattttaaccgcactgagtttaagcataaatacagttattgactaaattttatgttatacatcgtaaatatgcttaatcagactcacaaagaatttagaaaatcttgttttatttttgtgatttttatcacgattttatggtttgaatttataaattgtgataaatatcacgtttttatcactgattaaataataaaaaatgcggtctacatcacaaatcttaaagaaaaaatttttgcttttattataaatatgttattttttctgcctgaaaaatagccaattatttctctttacgcgttctatttattgaggttaagttatgctatcagcaaatgcaaaagtcaaaatccaaagtgttggacgtttcttatcaaatatggtgatgcctaacattggggcatttattgcgtggggttttatcaccgcactttttattccgacagggtggttgccaaatgaaatcttggcgaagttagtcggaccaatgataatgtacttactgccattattaatcggttatactggcggtaaattagttggtggagagcgtggtgcagtagtcggggcgattactactgccggtgtgatcgtcggtacagatattccaatgttccttggtgcaatgatcgcaggtccaaccggcggctgggcaattaaacgttttgacaaatgggctgatggcaaaatcaaaagcggttttgagatgttagtcaataacttctcttccggtattattggaatgattttagccattctattcttctggatcatcggaccagctgtaaaagtagtttccggttggttggctagcggtgtagatgtacttgttcaagcaggcttattgccactcacctcaattttcgtcgaacctgcaaaaatcttgtttttaaacaatgcaattaaccatggtattttttcaccgttaggtatccaacaatcacaagaattaggtcaatctgttttcttcctaattgaagcgaaccctggtcctggcttgggtgtgttgttagcttatatgttattcggtaaaggggctgccaaacaaacttccggcggtgctgctgtaattcacttctttggaggtattcacgaaatttattttccttatgtgttaatgaacccacgtttattaattgcagtgattgcaggtggtgcaacaggcgtatttacattggtattatttaatgcaggcttacaagcaccagcatctccgggggcaattattgccgtgttagctatgacaccgaaaacctctttcatcggtgtgattttatctgttatcgcctcttgtaccgtatctttcgtcatttcttctttcttcttgaaaatttcaaaagaagaaagcaaaaataccctagaagaaatgcaagcagcttctaaagcaatgaaaggtggtaatacagcaacgaaaagtgcggtgatagatttgaacgaggtgaaaaaaatctttgtttcttgcgatgccggtatggggtctagtgcaatgggtgccggaatgttacgtaaaaaagtaaaagatgctggcttgacaattgatgtaactaactgtgcgattaatgatttaccagaagatgcccgtttagttattactcatcaagatttaaccttgcgtgcgaaaaaacaagttccgaatgcaatacatttgtcattacaaaacttcttagataacaaattctacgacagtttagtgcttgatttgcaagctgcaacaaaagatactgtagtaccgatagcggaagaaaatgcgattgacgtcaagggtacaacatttactcttaacgcagagcaaattttcttgggcttgaatgcagacagcaaagcggatgcaattcgtttcgccggtgagcaattggtgaaatttggtttcgtgcaaccaagctatattgatgcaatgtttgctcgtgaagaattagtttctacttatttaggtgaaggtttagccgtgccacacggaacagcagaagcaaaagatgcggtgttgaaaaccggtattgtagtgtgccaatatccacaaggcgttcgttttaccgacgaagaagacggcgtagcgaaattagtaatcgggattgcggcgaaaggcaatgagcatattcaagtactaaccgcaattactaacgcattggatagcgaagaagccattgcaatactaacatcaactgatgatatagaaaaagtgctgaccttattgaaagcttaaaagtgcggtaaaaaatggcgtagttttgactacgccatctttgtttataattttattgattgggagagcaaaatgaacgcattacatttcggagcaggtaatatcggtcgtggttttatcggcaaagtattagctgatagcggagttcaagtaacctttgccgatgtgaatgaagcggtaattgatctattgaaaagacatcagtcttataacgtgaaaatcgttggcgacagcattaatgcgatggaaagcgtacgtcatgttacgggggtggattcaaaagacacaaaggctttgattgagctgtttaaaacggttgatttagttaccactgctgttggtcctaccgtgttaaaaattatttccggaactatcgccaaaggtattgaagctcgtttagccgcaggaaattttaagccgttaaacattatcgcttgtgaaaatatggttcgtggaacgacctttttaaaagagcaggttttcacacatcttacagaggaattgcaggcagacgctgaaaaatatgtaggtttcgttgatagtgcggtagatcgcattgtgccacctgtgcaagaagatatatcggatcctttgttggtaacagtagaggaattttgtgaatggatcgtagataacacccaattcaaaggtgatattccaaacattcaaggaatggaattaactgataatttgatggcatttgtagagcgtaaattattcaccttgaatacaggacacgccgtgaccgcctatttcggcaaacgcaaaggctatcaatttgtgaaagaaagcattgaagatcccgacatcaaagagtttgtagcggctgtcatgcaagaaagcggtgcagtgttaattcagcgttacggttttgaaccgcaagcacatgccgcttatattgaaaaaattctcaagcgttttgctaatccatatttagtagataatgtggaacgtgtgggtcgccagcccttacgcaaattaagctacaatgatcgcttaatcaaaccattgcgtggtactattgaatacaatttagctaatcagcatctaattcgtgcaatagcttacgcactgactttccgttgtgaagatgatccgcaagcagtagaattagcacaatctttggcagaaatcggtgtaacagaaacgttgaaaaaatacacggaattgcaagatgtcgttattattgagcaaatagctcaagcctataatgaagtaaataaatcttagacaaaagagcggtcagtttgcaaaacttcctaaaaaatgaccgctctttctctttcaagcataggaaaaacaagttgttatctgaagatcctatttatgaaaaattaaacggtaccgtttccgtgcgaggttttatgattgctactgtggcaatttttgaagaggcggtagatagtctgatcaatcgagtatttcgaaaaacagattttgtggtacagtcggtgattgactctctttttaccaacgatggtcctcttggtgatctcagtgtacgtctcaaagtgttactcggacttggcgtgatccaacacaatctattttccgacgtaaatgcctttattcaatttaaggaaacattaaataaggacgaaaaggaatacactttcgatgatgaaattgtactcacttttttgcaaaaattaacgctgttgatggataaatcagcacttgattttgagccattaatcgaagacaaaaacagccttacttaccagatgaaatctctgcgacgggaaaaaattattcgttcttgtttaatattgaccattgcagatatttaccgtcaattacaaatcgaaagtccattttgatcatttaaataaattggtacacaacacaaaggtaagcattgattttacagctaaaaacgcatcttaaaaaacaggtaaacaggtagtataagatgtctataatgaattttttagctgtaatttttccagtaatttctgatgaattcccccaaaactaccatttgacatgaccaaaatatgatcttcaggttgtgcctcagtaacaattaaatcaactaagttgtccagatttccagaccattttgccggttgcacacaatcattagcaatttcaactacattccaaggaatattttccggttgcaataaaaaaacataatccgctcttgccaatgctggtgctatttcatctttatgaattcccattttcatcgtatttgagcgaggttctagcactgccaaaatacgtgctccgccaccgaccttgtctcgaagtgcggttaatgttgcaagaatttctgccggatgatgggcaaagtcgtcataaacagtaaccccatttacttcaccttttacttccaaacgacgtttcgcattgacaaaagaatatagtgcttgacaagcatctttgacttgcacgcccacatggtaagctgccgcaatcgccataagtgcattattcatattatgttgaccgacgatattccattgcacttcaccggctttttttccctgatgataaacagcaaaatgcgaactgtcatgagctattctttccgtatgccattcctgatcttgtcccaaaaaatgcatttcagaccagcaacccatgtctagagtttcttttacagattgttcatgagcaaaggcaagaatacgaccgctcttaggcattgttctaatcatatggtgaaactggcgttgaatcgcttgtaggttgtcaaaaatatctgcatgatcaaaccctaagttattgataataagcgtttttggattgtaatgtacaaatttggaacgtttatcaaaaaatgccgtatcgtattcgtcagcttctataacaaaaaatggactcttacctaagcgtgctgaaacaccgaaattgccggctattccacctattaagaaccccggttgcaagccattttgttctaaaatccaacttaacataccggttgttgttgttttgccatgtgttcccgatacggcaagcacccagcgatcacgtaataaatgctcgtgtaaccattgtggacctgaacgataaggtaagctattttccaacacatactctacgcaaggattaccacgtttcattgcattgccaatgacgactaaatcaggtgctggttgcaactgcgaaacgtcaaagtgcggtatgatttcaataccattttgttgtaaaaaagtactcatcggagggtaaatattcgtgtctgaccctgtgattttatagcccatttgtttggcaataatagctactccccccatgaaagtgccacagatacccaaaatatgaatatgcttattgttcatttgtttctattccccaaaatgtataaaaaatgtgttatagatcacattgtgagaaatcaattcattcgttaaaaagtgaaggttgttataataaagcaactccaactgagagtaaatttaaattatggaaggattaaattatgaaaacattaggacaatttattgtagaaaaacaagcagaatatcccaacgctaaaggagagctatcagggattctatcttccttgcgtttagttgccaaaatcattcatcgtgatataaataaggcgggactaaccaacaatattattggtaattccggcgttgaaaatgtacaaggggaaacgcaaatgaagttagatttgtttgcacataatacaatgaagcaggccttgattactcgtgaggaagtggcaggatttgcttccgaagaagaagaaaattttgttgcctttgatactgaacgtggtcgcaatgcaaaatatgtcattcttaccgatcctttggatggttcctcaaatattgatgtcaatgtggctgtcggtacaattttttcaatttatcgccgtgtttctcccattggtacacctgttaccttagaagattttttacagccgggacataaacaagttgccgccggttatattgtatatggttcatcgacaatgttggtttatactacaggcaacggtgtaaacggctttacttatgacccctctttaggcgtattttgtttatctcatgaaaatatccaaataccgccaaacggtaaaatctactccattaatgaaggacagtatttgaagttcccaatgggggttaaaaaatatattaaatattgtcaagaaaaagataaatctactgaccgcccttacacttcacgttatatcggctcgcttgtttctgactttcaccgcaatatgcttaaaggcggaatttatatttacccgagtgcaacgacttatcctaaaggaaaattacgcttattatatgaaggtaatccgatggcttttcttgctgaacaggcaggtgggatcgcaagcgacggcaaagatcggattttagatattcaaccgaaagaattacacgaaagagtaccgctctttgtcggctcaagagaaatggtcagaaaagccgaagaatttatgcgtgaattttctgaagaataaccatttgaaaagacactgttttgtgtcataaaaaatctgcaccttaatcagttgattatttagttcaacttttggggtgcagattaacatgtatattggttttgagccttacttgacagaaattagaatttataatttacatttaaaacaaatgtgcgtcctcttgaatagttatttaaggttttttggtacccatcgcccacaccaaaaataaaggtcatttggcttgcagaatcattattcgcatctaatgggctaatatatcttttatcaaagacattttgaatttcccctttaatggttaaattttctgtcggttgatagatggcataaagatcaaaaatcaccggttgtgctttgatttcttctgtaccggcaattcgtacataagtaaggtatactttgccatctttagatttgaacgtccccggtaagataacatcgccatctactttatcaactttagctcgtttacttttaccgtagtatttggcaatgccgcctaatgttaattttccgtcaaataaacgtgttcctaggtcaagggaaccgtaatctttcggtagagacgatattttacttaagccgaacccttgtaaatattttccactgctactaccgtcatttacagcactactggaatcggaatatgaacttggctgattggttttttgtctagcataggataaattggcatagaaccaaccgatatcataatttaattcaaattctattccttgcattttaacaataggcgatgaagcaacaggaatgatctccgcttccgtaccgccggtaaactcttgtggcttaaaaataccgtgagtttgtgctgctgctgtagaactaagtttattttctgcttttttatagattgttttacccccttcgtagttaatatgggtaatatgtgcaacgcagtcatcaacggatacaggtttatcttttcctctatagctgttcgagctacattcctgtttgacatttaaaatataatctctgattttcgtttgatacgccaagattttaaagcccagtacgtcgaaatccgaaaatacgccatttttataaccgttaatcccgaattgaatagttttggctttttctgattttaaatcggttctcaccgctaaatcaccgatttcagagaaatacatttctttgatatttgggacacgatgggttttggcataactcacaaatggtgaaaagagcgggtgaaaatccgcagagaatgaagccgaataattatcatgtgatctggaaccgcctttttttagggtatattccataggtctacatctagcaatatcaacatacccattataaaattttggagtgcatcctaagtttttagcaccatttacgccatacaaatcaacaaaatctttagcggtattgtcagcccatactggtaaaccttgatgtttatatcctgtctcatcccaagctccattaataaatttatttctccgaaaaacctgcccactgtatttataaatttggcgattggcatttaattttaaggtataaatatcgtatttaaaggtttggtcaaaatagagggttttaaaacgttgttcgccatcgggttggaacgtattggattttgtgctgtgataaaaacaaggaagataacctgggtcacttctctcaggacaataatataaatccggagtaaaggttggttctccattctcaaaattataggctaattcacttggatggcgatttttgctgtatttatttttgaggatattggcacctaatgttgcttcataagagaatttttctgttatcggaatggaaaaactcatatttatatccatggtttttgcactatttttgctttccaacatatctttcagctttttgccattaaatacgcttcccttgtgataggtttgcgtagaggtattatccgccaagattaattcaaattgtaaattctctttcgggtttaattggtagtttaactggtaatttttattctctaaatttctgccggaaagtgcggtcgataaagtgcggtatgaaagaatggctttattatatttatcattatattcaattttggctaaatggcttttgggataatggagtaatttattcggatcatagggttgacgattgtacttttctattgcttctagagtacaactatctatccaaaatccccctttacaactttctcgtgccagtctcggtaaattatcttctctatctacatctacaatattcgttccaccacctactttaaaattttgcgagcttttacgccaactatacgcatacataaaacctaatgttcttgtatcggaaaaaggatagcgaaaagcaaccgcacccatataattaggccctatagcgtttgtaccccccccgcattcaataaaatacccgctctattaccttcacttatcacatcatcaacaccaattgttctaaagttagcagaaccaattaacccatttacaccaccttttccactaataccacctcgttgaatatctacactggtaataaacgcagggtcaatggttgcaccgaattgagaggttccaccggatttttcgctgttatctcccgatgtggcaaaaaaggtttgggaaataccgtccaccatcgtattcacccgtccaaatcccgtttgaccacgaacgttcaccgacactgtccccgaacttttatcaaggttggtaaacgcacccggtaccgttctgatgatgtcatcaatagactgcgttgacgtggaaatattttctctcacactggttgcccccgcttttttaaagacttcctgtttaggtggtagcttatattctacgttaatttgatcgagcatttcttccgcataaacacaagtgcttaatacggaaaaagctaccgcagtgagtttaaatttattagacataattttcctacttatgtatggttaaaaagattggtaaacawgtagggcagttatataaaaatatccctcgcatgtcaattaatgataataatttttattattattttatttccaagaatatgtaaagcctactgtgccattgcatttttatacaccaaatctgtaacgccaaacacaacggcactgtttcccgacttaatgtccgcactggcagtgtctgccgaggcatctaatttggaatcgtcagcgactaataaaatagtcggtgcattaggtgctatctaattgcattttaccggtcgagtagcaacgttccatttgattttaaagatggtattcatagtgggattccttgtgtgaaagataaaaaataagacctagttctcatatgccaagaactaagccttatcgaagaaatgaataaaaaagaggtgtattcgttagttaaaaacgaatacaatcgtgctgtgctgtcatcatagattatgaatttcttgcgtcattcttcaaaccgtctgattgtataaaaaataaatctttttgtctaactctaacaaagaaataaaaatacgtttatactgaaaattttaatttctttgttttcattgcataatagtaaaaatctcatagatggaaggaaaaaataatgaaaaatatgttactgatgagcagttctaaatacaaagataccggttacttaattcatacattaccttggttggatcaatttttgatggcatataaaggtaaaaagctcgcctttatcccttatgccggcgtgactcgttcttttgatgaatacgaaatagcggtgcaacaagctttatcttgtttaggcatggaaattatctccgttcatcacggcaaaaaacatgcagacattattgagcaagccgatgtgatcggcattggtgggggcaatacgttttgcttattacaacggatgtatgaatataatgtcatgaatattattcgggagaaagtaaataacgggacaccttattttggttggagtgcaggggcaaacgtagcgggtagttcaattatgacaactaatgatatgccgattatttatccaccatcttttactgcgttaaatctatttccacatcaaatcaatcctcattttatttcaagcaaaattcaagggcataatggagaaagtcgtgaggatcgattaaaagaatttttaatcatcaatccgaccgcacttgtatatgcgttgcctgaaggtactgcgttgcatgttcaaggagaaaaagcaacagttcttggtgaacaaaaggtgttacgttttagcgaaaatatgcaactgagtaccttagcacctcattcgacatttaattattaaggatataactatgatacagtttaattctattgtggctattcttggcattatcgccacggtttatcttctcattaaaaaatatgaaactcgtacagtattaatcagtgttggtttgttgatggcaatgttgactttcaaaccaatggaggcgtttgatgcttttgctaaatccatgaccagtagcggtttaatcatggctatttgttctagtatggggtttgcttatgtgatgaaatacactcaatgcgatacacatttggtacatttaatgactcgtccgttaagtggtttaaaattctttttaattccgattgcaacagttattacgttctttattaatattgctattccgtcagcagcaggttgtgcagcggctgttggtgccactttaattccagtattgaaaagtgcgggtgtacgtccggcaacggcaggtgcggcgattttggcagggacttttggttcaatgatgagtcccggatcttctcatagtgcaatgattagcgaaatgtcgaaattgaccattaccgaagtgaatttgtctcacgcaccttacactatgattgcaggtgcaatcggcacagtagttttaactttgttagcgattgtatttaaagattacggtgaggaacatcggaaagcctatttacaagaaaatcaacaaacggaaagtactttcagtaaggtgaatatattctatgctttagcacctctcgttccgttgattatattggttctcggcggaacctctttagctgaaaacccaggattagcgtggacaaaaatgggcgtgccacaagcaatgttaattggtgcgatttatgccattttagttacccgaatttctccggttaaaattaccgaagaattttttaatggaatgggtaattcttatgccaatgtattagggatcatcattgccgcaagtgtgtttgttgcaggattaaaagcgacaggagcggtagattccgctattgaatttttgaaacattctaacgaatttgtccgttggggagcgactatcggaccattcttaatgggtttggtaacaggttcaggtgatgctgcggcaatcgcatttaataccgctgtaacaccacatgcagtggaattgggttatacccatgtcaatttaggaatggcggcggctattgccggagcgattggacgtaccgcttctccaattgcaggagtaaccattgtttgtgccggtttagcaatggtaagtcctgtagaaatagtgaaacgtactgcactgggtatgattttggcaaccttatttttaacgttatttatgttataaatataagtaagactgaccgcactttgataattcatttgacaaggtgcggttaaagtttggagagtttaatgggggatatatgacgaatttagctagattaattgaatggcgaagagaatttcaccgttttcctgaaactggttggacagaattttggacaaccagtcgcatcgctgattatttagaagaaatgggggctgagattttactcggcaaccaaattattcatcatgattttgtgcgtggtcgtgatacgaaattagttgagaaaggcattgaaagtgcgatttcttatggtgcaaaaaccaaatggctagaatgaatggctatacaggttgtgttgctgtatttgattctggtaaacagggaaaaaccttggcattacgctttgatatagattgtgttaatgtgactgaaaccaatgatcccaatcatttacccaataaattaaaatttgcctcattaaatctagggtttatgcatgcttgtggtcatgatggacacatcacaattggtttaggtattgcgtcatggctttcacaaaataaggataaatttaacggtaaagtcaaaattgtctttcagcctgctgaagagggagtgagaggcgcagcagctattgctgcaagtggagtgattgatgatgcggattattttgcctcttcccatattagcttttgtgccaacacaggtactgtcttagcaaatcctcgtaatttcctttccacaaccaaaattgatattcgttataaaggacgacctgcacatgctggtgctgctccacatttaggtcgaaatgcattattagcagcggctaatgccgtaacacaattccatagcattgctcgtcatggtgaggggatgtctcgaattaatgtaggtgtattaaaagcaggtgaagggcgtaatgtgattccgagcagtgcggaaattcaacttgaagtacgtggtgaaaataaagagattaatcaatatatggtggatcaagttatgcaaattgccaaaggtattgcgattagtttcgatgtaagttatgaaactgaaattatgggtgaagcagtggatatgaataatgatcttgagttagttaaattgatcgaggaaattgccattcaacaacctggaatcaatgagtctactgctgattatgcgtttaatgccagcgaagatgcaacgattttagggcgtcgtgtgcaagatcatggtggtaaagcgatttattttattattggtgctgatcgtacagctgggcatcatgaggcaaacttcgattttgatgaaaatcaattgctgactggggtaaatatttatattggtttagtacagcggttattggggtagtattgagtttttaatttattttcgattaaaaagtgcggtcagtttttcatgagaatgaaaactaccgcacttcttgtctattgaattattaacagttctagcagttttttttgctttcaggtacaatcagccgattaaattttatcttatattaatgaaaaacttttagattttatttttatgaaaaatattcgtaacttttctattattgcacacattgaccatggtaaatcgactctttccgatcgcttaattcagagttgtggcggtctttctgatcgtgaaatggaagctcaagtactagattcaatggatttggagcgtgagcgaggaattactattaaagcacagagcgttactttaaattacagagctaaagatggtgaaacttatcaacttaactttatcgatacaccgggacacgtggatttttcctatgaggtatctcgttctttagcggcttgtgaaggggctttattagtagttgatgctgggcaaggcgtagaagcacaaaccttggcaaactgttataccgccattgaaatggatttggaagttgtacctattttaaacaaaattgatttgccggcagcagaacctgagcgagtcgctgaagaaattgaagatattgttggcattgatgccattgatgcagtgcgttgttcggcgaaaaccggtgtgggtattgaagatgtattagaagaaattgtacgtaagatccctgcaccggaaggtgatccgaatgccccgttacaggccttgatcattgattcttggtttgataattatttgggtgttgtatctttagtgcgtgttaaaaacggtattttacgcaaaggcgataaaattaaagttatgtcaacgggtcaatcttataatgttgatcgtcttggtatttttacaccaaaacaagtagatacaacagagctgaaaacaggcgaggtaggttggcttgtttgtgcgattaaagacattttaggggcaccggtgggagatacattaacttcacatcataatccggcaacctctgtgcttccgggatttaaaaaagttaaacctcaagtttatgcagggcttttcccaattagctctgatgattatgaatcatttcgtgatgccttaggtaaactaagtctaaatgatgcgtctttattttatgaacctgaaaattctaccgcacttggcttcggttttcgttgcggttttttaggacttttacacatggagatcattcaagagcgtttagaacgtgaatatgatcttgatttaatcactactgcaccaactgtggtttatgaagtggaacaaaccaatggcgaagtgatttatgtagatagtccggcaaaattacccccactaaacaatattgctgaaattcgtgagccgatcgcagaatgtaatatgcttttgccacaatcttacttaggtaatgttataacactttgtgtagaaaaacgtggagtgcaaacgaacatggtatatcacggtaaccaagtggcactgacttatgaaattccaatgggtgaggtcgtgttggatttctttgatcgccttaaatcaacttctcgtggttacgcctcgttggattatggttttaaacgttttcaagcagccgatatggtgcgtgtggatattatgatcaacggtgaacgagttgatgcgttagctttaattgtacataaagacaatgcacaatatcgtggacgtgaattggtggaaaaaatgcgagaacttatccctcgtcaacaatttgatattgctattcaggcggcgatcggcaaccacattatcgctcgttctactgtaaaacaattgcgtaaaaacgtattggcaaaatgttatgggggagatgtaagtcgtaagaaaaaattgttacaaaaacaaaaagaaggtaaaaaacggatgaaatctttaggtaatgtagaagtccctcaagaagcgtttttagctattttacatgttggtaaagataagtaaggaaacaccaatgtctaaatcaaatttatttttcgttatattaattgcagcgggatatgccatttggaaattacttgatcatttggcactaccgaatacattcaatattttattaattttattgaccgcactttgtggtgttttatggtgctataaccgttttgttatcttgcccaagcggagcagacaaatttctcgtgcagaacagcgtagcggtaaaatattaacggatgaagaaaaaagtaaaattgagccgatttctgaggggagtgaattgttagcttccctatttcctgtattgactttcgtacttattttacgttcttttctttttgaaccgtttcaaatcccatctgtttctatggagccaaccttgcgtgtcggggattttttattggtcaaaaaatatgcctatggcattaaagatccgatttttcaaaacacacttattgaaacgggaaagccgcaacgtggtgatataattgtctttaaagcacctttagaaccaaatattgattatattaagagaatagttggaatatccggagatcgtgttttttatgatgaaaaaacgcgtcatgtgacaattatttataataaagacggcaaagaatgtgtttatgattgtcaaataaaggaatttagttacagcgagccacagcgtaatcctgaatttaccatgatcgttggtaaggatgcacaaggaaaagctatctatggcgatgaaaatcctttggtcttaactgagaaaggcgatgtggaacatcaaattcattgggatccacgcatttttaaccgcacttatatgtacagtggttaccgtcagcaaaaagattacgtaaccgaatggattgtaccggaggggcaatattttgtgttgggtgacaaccgagatcagagtgcagatggtcgtttttgggggttcgttccggaaaaaaatattgtgggtaaagctgaatttatttggttgagtcttgataaaaaacaagatgaatttccaaaaggcattcgtttctcaagaatgtttacctcaattaaatgacaaattattgacttaataaaacgccctttaaattaaagggcgtttctgtgttatgaaaaatccggtaaaagtgcggtagtttagtcgcaaaaaataatatgtctttcttttattttcaaatagattaaataggggtattatgttccattatttttgatgtggaacatcaaatttacgtttcttattgatattcttgaaaaaaattatgcaactggaaaaattacaaaaaaaattaggtcaccaatttactaatcttgattatcttaaacaagcattaacgcatcgaagtgctgctgcatttaataatgaacgtttggaatttctaggtgattccattctaaattttgctattggcaaagcactttacgaaaaatttcctaagtctaatgaaggtgaattaagccggatgcgtgcaacgttggttaaagaacaaactttagctgttgtggctcgccaagttgaattgggtgattacttaaaactaggtgccggagagttaaagagcggtggatttcgccgagaatctattctatctgattgtgttgaagcgttaattgcagcgatttatttagatgcaggaatcgatgttgctttagctcgagtttatcagtggtatcaggaattacttgaacaaataaaacctggagaggcacaaaaagatcccaaaacacgcctgcaagagtttttgcaagggcatcgcttaaaacttcctgaatatgaagtgatagaaattaagggagatgctcacaatcagtcttttagagtgagctgtaaagtggaaacacttactgacgtcgtttttggacaagggaccagccgccgtaaagcggaacaacatgctgctcaacaagctattgaaaaactgaaaattaaataactatacctgtcgggacaatatttttttgtccttgcataatatgagagaaaaaatgacagaacaagaaacttattgtggttttatcgctattgttggacgtccaaatgtgggtaaatccactttattaaataaaatcttaggacagaaaatttccattacttcacgtaaagcacaaacaacaaggcatcgtatagtcggtattcacactgaaggtgtttatcaagcggtttacgtagatacacctgggttacatattgaagaaaaacgtgcgattaatcgcttgatgaatagagcagcgagtagtgcaattggcgatgttgatctgataatttttgtggttgatggcacacactggaatgacgatgatgagatggtgttgaataaattacgtcgtgcaaaagcacctgtcgtgttagcaattaataaagtggataacattaaaaataaagatgaacttttaccttttattacagacgttagtcaaaagttggagtttaaagaaattatcccaatttctgctcagcgaggtaataatattcacaatttagaaaaaatagtccgcacttctttacgtaaaggagtacaccattttccggaagattatgtaacagatcgctcacaacgctttatggcatctgaaattattcgggagaaattaatgcgttttacaggggaagaattaccctactccgtaacggtggaaattgagcaatttaaacttaatgatcgtggtatttacgaaattaatggcttaattttggttgaacgtgaagggcagaaaaaaatggttatcggggcgaaaggacaaaaattaaaaactatcggtactgaagctcgtcaagatatggaacgtttatttgataataaagttcatcttgaactatgggtaaaagttaaatccggctgggctgatgatgagcgtgcattacgcagtttaggttatatagacgaataaaataaaacattaaggagacaaattatgtacttggaacaagtgaaaactgagttatttgaagcacaagatgtactaaataaatttatcagtaacgaacaaaatatcaagctcattcaacaagccgcattactgatttcggatagttttaaacaacacggtaaggtattatcttgtggtaatggcggttcacattgtgatgcaatgcattttgcagaggaactaacgggacgttatcgtgaaaatcgtccggggtatccggcgatagcaatctcagatgttagccatttaagctgtgtaagcaatgattttggctatgaacatgtattttctcgttatgtagaggctgttgggcaaaagggcgatgtattattaggcatatcaacctcaggtaactcaaaaaatgtattaaatgctattgaagcggcaaaagccaaaggtatgaaagtgattgccctgacggggaaagatggtggaaaaatggcgggacttgcggatgtggaaattcgtgtacctcatttccgttttgcagatcgtattcaagaaattcatattaaagttattcatattctaatcatgttaattgaatttgagatggctaaaattagacagtaattttttaacctttttgtactattacagagaaagattttatgtcatattacaataatgcaatcttccctttgcttttagtgtaaatttagattaaaatcgcaacccttgttttagggtcaataattcgtttattgaacaatattaaattttgcaaaatattaattaatcattgaggtgatggcttatgccagtaattaaagtacgtgaaaacgaatcattcgacgttgcattacgtcgtttcaaacgctcttgtgaaaaagcaggcatcttagcagaagtccgcagtcgtgaattttatgaaaaaccgacaactattcgcaaacgtgaaaatgcaacgcgtgctaaacgtcatgcgaaacgtgtggctcgtgaaaatgcacgtaatacacgtttgtactaattaaaaaatttttttaattaaactcgagttaaacagaccgtgaaacctcataggaatcacggttttgtttcttttataaattctctatcatatttgcttttatagtattattaggctagtttattcctatttgatgctattttagggatttatcttttttatgtcaggcaaaataccgcattcatttattgatgatattttagctagaacagatattgtagatctgattgattctagggttaaactcaaaaaacaagggcgagattatcaagcctgttgcccttttcatcatgaaaaaacaccttcttttacggtgagtccgaaaaaacagttttatcactgttttggttgccacgcacatggaaatgcgatctcatttttaatggaatatgataaattagaatttgttgaggcaatcgaagaactggcttctttgcatggtttagaagtcccgagagagaaatctacgcttgatgaaaaaacacgagttagttttaaaactaaacgcaatctgtacgaactaatgcaagaaattgcaaaattctatcaagagcaattaacgcaaaatatccccgcacagaattatttacaacagcgtggtttatcaatagaaattattcaacgttttcaaatcggcttttctccacagcaatctagtttttttataaaaaaatttgccacaaatagagaagaaattcagaaattatttgatgtgggaatggtaaataaacgagagagcggtgaattatttgatcgttttcgtcagcgagttacttttcctattcgagatagaagagggagagttattgcttttggggggcgaattattacccaaagtgataacagaccgaaatacttaaactctcctgagagcgtaacttatcataaaggttatgaactttatggtttatttgaagcgttacaaattaatgatagtcctgaaatgttggttatcgttgaaggctatatggatgttgtcgctttagcacaattcggcgttgactatgctgtggcatctttagggacagcaactactactgagcaattacaattagcctttcgttcaacagaacaaattatttgttgttatgacggtgacagagcaggaagagatgcggcttggcgtgctttagaaaatgcacttcctttattggaagatggtaggcaattaaaatttatttttttaccggaaaaagaagatcctgatagttttattcgacaatatggcaaagaaggatttgaggattatattcatcaagcacaatcattaagtgaatttttatttaatactttaagtgctaaagttgatttttcctcaacagaaggaaaagccaaattagcttctcttgcaattcctttaattcagaaagtgccgggagaaatgttgcgattgtctttacgtgatatgttcggtcaaaaagtaggcatatttaatccggacaagttagatagattactatccaatcaacaacaggttgaatataaacaaaaaattccgaaaacagtaaaaagaacaccgatgcgagttttaatcgcacttttattacaaaacacaaatttagctaaaattgtccctgatttatctccactaaaagttttacaagagccgggcttggatttatttgaaaaaattgtaatactttgtcgtgaaaatgttggtatacgagctggacaaattttggaacattggcgagacacggaatatagccaagcacttgaaattttagctacgtgggagcatgctgttgatgatgataaaattgagcaagaatttagagaaaccttgattcatctttataagcagttagtcgataagcgtattgaagaattaattggtcaagaacgtatggttggcttaactaatgatgaaaagatagaattagcacaattattatcgaaaaagcaagaaaagaaatagttaatcttttataagaatggtagaattctccattcttcaatccttattaatcgaggcagatattaaatggaacaaaataaacaatctcagctgaaattgttaattgcacgaggtaaagaacaaggttatttaacttatgccgaagtgaatgatcatcttcctgaagatcttgttgatgctgatcaaattgaagatgtgattcaaatgatcaatgatatgggtattcaagtacttgaaagtgtgcctgatgctgatgacttgatgctcaatgaaaatattacggatgaggatgctgttgaggaagcgactcaagtattatcaagtgtagaggcagagttaggaagaacaacagatcctgtgcgtatgtatatgcgtgaaatgggaagtgttgaacttcttacgcgtgaaggcgaaatcgatattgcaaaacgcatcgaagaagggattaatgaagtacaaagtgccgtagccgcttatcctaaagctctcaattatcttcttgaacagtatactttagttgaagaaggcggtatgcggttggctgatctcattaccggttttgttgatccaaatgcggttgttgaagaagagataattgaagccgacgacatacttacagaagatgatgaagaacatgtagaaagcaatgttgatgtaaacgatgaagaagaggaagaagatagcgaagataatagcaatgtagactctgattcggataacacaattgccccagaagttgctcgtgagaaatttgaagcactaagaatacaacaccaaaaaaccttagccgcaatagaaaaatatggtcgttcccgtaaacaagcaaaagatcatattcaagcattagccgatatttttactcagttccgtttagtgcctaaacagttcgatgcgttggtcaattatatgcgtgatatgatgaaatctgttcgtcagcatgaacgacaaattcaaaagctggtagttgatttggctaaaatgccaaaagaaaatttccaaaaattatttattggtaatgaaagttcagagggttggctggataaattactgcttgcaagaaaaccttggtctgaaagattaatacaacatgaaagtgcggttcgtcaaagcataaaccaattattaaaaattgaacaggaaaccaatttaactatttctcaaattcgtgaaatttgtgacaaagtggcacaaggagaattaaaagctcgccgtgcaaaaaaagaaatggttgaagcaaatttacgtttggttatttcaattgcgaagaaatacactaaccgtggattgcaattccttgatctcattcaagaagggaatattggtttaatgaaagcggtagataaatttgaataccggcggggttataaattttcaacctatgcaacttggtggatacgtcaagcgattacacgctctattgcagatcaagcaagaacgatccgcattccagtgcatatgattgaaactatcaataaattaaaccgcatttctcgtcaaatgttacaaaaaatggggcgtgaagccacatctgaagaattagctgaacgaatgggaatgcctgaggataaaattcgtaaagtattaaaaatcgcaaaagagcctatctctatggaaacgcctatcggtgatgacgatgattcccatttaggtgattttattgaagacaatacgttagagctaccgttagattctgcgacagcccaaagtttgcgtgctgcaacgcatgaagtgttggaaggactaaccccaagagaagcaaaagtcttgcgtatgcgttttggtattgatatgaatacagatcataccttggaagaagtcgggaaacaatttgatgtaactcgtgaacgtattcgtcaaattgaagctaaagcattgcgtaaattgcgtcatccaagtcgttctgaaaccctacgcagtttcttagatgagtaaatgatgagattaaagaaagttatcacgttcttttctcaaacattttggcacgacaaataatcaaaattaacctaaaaaatataatccctattgaaagaaatggctcaatagggatttttcgttatgctaaaaagtgcggtgattattcaatcctatttgagcatcaaacatttttaattgttcgcctcaattaagttaggataaaaagtaaaaaaatcgtttctttcctataaaaatttaggataaaataacgagaattttcacttgacaaataaaatagaacggaaaaaatgacagtctacagtctacagtctacagtctacagtctacagtctacagtctacagtctacagtctacagtctagtatattgcctaaaatcaaccttgcaagttaaatttgtgaggttggatatgttcaaacaatatcttaaaaatcacctatttcaacctcaacctttcggcgaaagtattattcgcctttttctgctttgccttaaaaagcaaggtatcgcctatttaggtttataacctatctctctaaagtttaataaataatcagtaagagataataaataaacaataacagattcgatcaataaccatttaataagtaattaacagataatttttaaagcgagtaaagaatatgaacaaaatcttcaaaaccaaatacgatgtaaccactggacaaaccaaagtggtgtctgaattggcaagcaatcgccaaatagcgagcagttcgaagagtaaaccgaagtgcggtgattttttgggtaattttttaggcatttttaaattttcaccgttggcgttgttgatgtcggggatgcttggtgtgagtagtatttcttacgctgctgttgtatatattgatatggaagcaactacaggtgctgctggagtaagacaagattggagagaatcacaatattggaaaaatagaggaagtgaaaatattttaatagcacctgttcaagctgatagtgttaatcaaaatttaaaaaggtatggtcgcggaataaatacaagggtacaaaaatctgtaatcataggtcctatggcggcaggtagagatgatcaagcaggtatgactgtattaggtcatggtgcagtcggttatagtagtcaaacaactgcgattgggaataatgtctatactggaggtgaacaagctacagcgataggatcagatgttatggcagcagggtatgcctctatcgcaataggaaatgatgatatatatagtcaaggtggatannnngacgcattaccggaaaatattattatggaaatctatgggtatgatggaaatcatcaaggaaaaacaacttataaggacatattagacagagatatatttgtagataaatatgggaaaaaacctaatcaagataatagacactattctccaacttattcagcaggaatgggagcaatcgctatcgggtcaagatctgttgcctatggtgatacttcacttgctttaggaaccttatcatttgctttggctaaaggctcaaccgctgttggcgttcgtgcatttgttagtgaagatgcagaaggcggtgttgcgataggtgacgcatctagggtatttgctgckaattcatttgctgtaggwaaykawkcagarkcarcaaataaaggggctgtatcttatggytcarrmgcaaaagcrgtgggtrmcggttcgrtmgcaataggcaccaaagtagcctctaatgctaagataaatgaggcttcagctagaaggtttagagacaagcttatgcaagaactaggtattggaactattcgggaagataaacaaaaagaatttcatacaagaataacaactgaagttaaagatttaaaaactggaaatcagaatgagattgttaaatctgggtttgctaatcatttagacgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatcagtaaaaaagaaagagagagagggaaatcaygcyrtaactrtrggttaytayacygcaaatagtggagataataccgtagccataggcacagcttcctatgtaaaaggtcaaaattctgtcgttttaggagctttgaacaatgtcgggaaatatgcaagtaatgcggtagcgattggggttggaacaaatgtacataaagaaaactcaatcgctttaggaacgggaacaacagtaacaggtgcgggcgttgtggctatcggttccggcgttggtgtaacaaaagacaatacaatagctgtgggttatggagcagtaggagaatcaagcgaaagtattatcttaggaaatgaagcaaagataaaggatcaagcaaagaaatctatagttatcggtaatagtgcaaaagttgaaaannnnnnnnnnnnnnnnnnnnnnnnnnnnnnnnnnnnnnnnnnnnnnnnnnnnnnnnnnnnnnnnnnnnnnnnnnnnnnngaaatgtccgctattgctatagggacaagttcatctgtttatgctacaaagggcgtggcattaggggataacgcaagtattggaaaagatgctagtagttcaatagctttaggtaataatgccgaagcagatatgatgaactcggtggcgttgggttatcaatccacaacaaagtatttttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagtgcggtcggtttacgtcggattgtcaatgtggcaccgggtgctttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgggcatttagcgaaaggggagatttcagaggtttccgatcaggcgattactggggcacaacttgatgatcttaaaggtaagttggggttgacattagataaagatgatccaacaaaatttgataaagttaaatttaacgcagtaaatgtaaccgattcaagtgatacatcaggagtaataacaacttttgaagaggctatccgtaaaagtattgcagctatcaatagaggctataaatttgaygatggaactaataatcctackactaaagatacacctttttatttaggttcaaccattgtaatcaaagcaggggatgttacaaagtcaggtacaacgacagagaactatctaggcaaaaacctaaaaacagaatttaaaaacgatagttcaaaagcgacattcaccatcggcttgaaagacgatccggaatttaaractgtaaagattgacacgattgaggataaagaaactactgataaaaaacttgccgtcaacaaagagtatgtggataacaaactcaaaaatgtctcgaccaatttacatttcttatcagtacaagggatggataaaggcaatggttcaaattacaacaacgacggggcaaaaggcactcattctgttgcaattggggtgaaagcaagtgctacagcaaatgcgacgtctggtatagcgatagggtataacgctaactctaaagcagaaaatgcagttgtaataggtaataatgtaagtgtagatgtacatagttcgtttgtactagggtctaataataaagttacgcaatcatttaaaaacataaatggtgckgtkgttgtaataggtagtggaacaraattaatagaatcwaaaagttctatagcwataggtgcagtttatgtaaaaggtaaaaacggagaagatggaacaaaaatagaaaacgccgcttggacagcgtctatcggtaataaaaataaaatcaaaaacggtacggatattgtggcgttagggaacaatattcaagcattagatacgacagatgaaatgtctagtaatggaacaaagaatgcgaatacagatttaattctgattggtaatggagcgacagctgaaactgcaaaagaaagtgtgcttattggggcaaaatcaaaagctgaaacgggtgcaaaaagtgcggtgattattggtcatagtgctaaagccgagagagacgccgtcggtgcagtagcgattgggcaaggtgcaacagtaaaaaccgccgctggsraytccattgccttggggcaaggstcasaagcgactaaaaaagaaaccgcacttaatgaagctaaaatagaggctattaatgttaaatttaatttcaaaagaggagtgagtgctaatggtcaagaaaataataaaaaatccgttttaagcataggtaataaaggcaggtaaagacaaatcaaacacgtcgccgcaggtgcggtaacggaaacttcaaccgacgctatcaacggaagccaactttacgccgtcgctgatgaattttcaaaattagcggtgaatgtattaggtgcggaagttgatacaactagcggatttaagaaatcagaatttaccgttgttcaatatcatggaagtacaaatacaccaacacaaaaagaaatgacttttaaagacgcaattggtcaaaatacaatagcgattaataaaggctttatttttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaataggcataaaagaaacaccaacttttaaaaatgtattaattacagaagaaattcctgaggatacgtcagatagtgctaagaaaggtaattatgataagcatgctgtcaacaaaaaatatttagacaaaagattagaaaaagtcgccgctaatttcacggttaagggggataattctaaagatggaaaaagttataccttagataaagagcataatgaattaaatattaatggagatagtgaaaatatcacaaccgcagttgttgatgataaaggaataaaaatatctcttaamaaagaattaamaggtatcacttcaattgctaataatgatacaaaaattgaattaaacaatggaactggtggaartggaacaaaatctatcgttttcacmgytggaaattcarrtaagaaagtaacattaactgaagataaattcagtggtgtgtctgaaattagcagtaaagataataaatctacattaaaacttggtgctgataaagcaactgtagaattagctcatgacaaatcaaaacttgaattaaaagatactgaagcaacaatcacagctggaggtaatgccggaagtattaaaattaacaataatggtgataagaaaattgagttaagtcctgaaaatggagctaaattaacacttgcaaaagataacggctctagcaatgttaaagctaccggtttatctcttgttgggttaaatgaacaaaacgctttaatctttaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagcggaacgcatgcttacgccgtgggtgcttataatgacatcaaaggcgaacatacttatgtcttgggttcaaatattacgacaactaaagatataacaaatgctgttatcttaggtaatagatcaacaggtgtatctgatgccgtgtctgtgggtagtgcagataaacaaagacgaattgtttatgtcgccgatccaaaaaatcaatacgatgcggtgaataaacaatatgttgatggacttggattaaaattcaaaggtaatgataatcaagagatacataaaaaattatcagacacattagaaatagttggtaagggtttaaataaagctcaaactactaaatttaatggcacaaatggaaatattgcggttataaataataagcaaaataaattggaaatatcattaaatagagatttaaaaggaattaaatctattagtgatagcaagaataaaaatatagctactgaaataagattcaatagaaaaaatgacacaaacagtatttctaatagtttgataacgaacctaactatttcttcaaatggaggcacatttgaatttaatagaacaggtttgcatatcaacaacaaacaaattacagggttaagaagcggactattagaaaaacacaacggaaatgattctgaaagaaaaggtttagacgatttaataggagaaaattttgataaatcatcgattaaaactcatgcagtcaatgttggagatttagctaaaatttctaaggaaatagttgaaaaagggtataaatataacgctgatattctgtcaggtaatagcaatgataccagcataaaactaggctcaactatatctattgttaaatggacaaactcgccggcatcggggactggacaaccagcagtaactgttggcacaggaacaacttctcaaacacaagctgttaagtacacaggagataatttaacaactcgatatacctatgacggtggcaacgctaagatagaaattggatttaacgaaagtccgacatttaaagctgttatgcttgctgaaaatcaaacatataatggcggaaatgcagttgatggcaaagaactcatcactaaaggctaccttgaacaagcgttagataagtttaagttcaaggttgaaaatggtagcggtaagcctatagaaatcggtcgtggcgatacgttgaagtttaatgctggcttcaatattcaattaacgttagctaaagagggtgaaaaaccggcaaatggggcaacgtctgcaagtagcacaagtgcggtaacttctaccccagctccgaccgctccagccgtggcaagtagttcagacagttctgctccagctagtaccacatcaggtagtgcaggtggtgcggttgcgtcaggtggtacaaatggcgatagtgcagatacwgyggtcgcttcaagctctccaactgcgggaacttcaagcacamcaacgaccacgccaagcgatacgagtacaccaaccactactacaccaacaacggcwgtrgtmaccattggcacgamwrakgatttrammrayatyacctckatttcctctaaagctggaagtgcggrcggaaatgatgcaaatggtrcaactggagamgtgactaaacttaccttagatccaactgatggtgcgactttccaagtgggtagtcaaggtgcgaaagtgaatatyratracrakggtattgcactsaygccacaaggggcgaatggtgcagatggggcgaataatccaaatgctgaatcgccatctattactattaamgcaggtrcaaaaccrgyggatmmaaayagcytagaatcgtttgagaaagrtcaagrwccwtctattrcgttntccacaaaagatactgayggtaagaaaatcggctcaggcaaaatcaccggtcttgctgatattaaasmggrggaaamagacggcaccmttgcagcgaataaaaactatgtggatgaaaaagtatccgacttaaacaataatcgcccgtttgatttttatttaggcaatgaaaaagtcgtgaaaggggctgatggcagtttccacaaagacggtaaacctagtgaaaaactttctgaggaagagaagaaacaagtcgtgattaaagccgaaccaagcacctcacctatcgggattagcaatgtggcgagcggtttgggattagctgcccctgaaaaagacatggctaaagcggaagaagcgaaacaaaaaaccgcagaattggcaaaagcggttgagggtaaggtgaaagatgtcggtgataaagccaaaacactatcccaaaaagcacaaactttcacggatttagcgttagcggtgaatagcttagaacaggcgataaatgcgttgccagaaggcgaggataaaaagctggcagaaactaagttacaagaaagcaaaacgaagcttgatgaggctaaaaaagagcttgaaacagcaaaaactgmtttaacngaagctcaaaaaggcttaacarawgccaataamgcctatgaacaaaattacaaaggctatgaaaaagtcgctgacttagtcagtgccgatagtaaagccgaattaaccaacgtagccacaaccggcgatttgcaagcggtggcgaaatccggcatgaagttcaagggtaatgacggcatggaagttcgcacgccattaagcggtaccttggtgatcacgggcgagggcgacacatttaacagcaacctcaccgccgccggcaatatcaaagtggaaatggcacaagacggtaaaggcttagaagtgaaattgtctgatcaattgaaaaatatgacttcgtttgaaactcgtgaagtgaacggtaagaaagcccgcttggacagcaacggtttgagagtggaaaatacaagcacaaaagaacgctctcatttaagcgaaaaccgtttggcgttctatgatgaaaaaggattgggattgaatttagatggcaaagatcgagccttaaaagtgagtgaaaaagcgattattagcatcaacggcaaaaatgaggctttagttgaagatctcaatgcctctagttcaggtcaggcaattgcgaataaaaactatgtggacgcaaaaaataatgaattgcgtacacagcttcatagtgttaatcgtgaatcacgttcaggaattgccggtgcaaatgcagcagctgcgttgccaatgattgcgatgccgggtaaatcagcacttgctgtctctgctggggcttataaggggcaaagtgcggtggctttgggctactctcgtatgagcgataacggtaagattatgttgaaactacatggcaacagcacctcaaccggcgattttggtggcggtgtcggtattggctgggcatggtaagtaacgccctttgagctaaaaaagcagtgaatgatgatctgctccttaatcagttggttgtttagtccaacttttgggtgcagatcggaatcactgcttttttgatgcggatttactatgatactttttaatggtgatggaactgtaatatcatcaccagcccagtattagtcttaggtgaaagcggttagaatatattaacttctgtcctcgaaaaagaaatattcattgagggtgatagaagaaattcactgatgtattaggggagttagtaggaatttcgttttttagagagaggagaacatcaatatatgaaatattcgtttatttcataatgaatcggcatataatgtcaacctttcatgttaaataaaggattcgcattatggaattttctgtttatctacaattttttattgggttaattgcgttggttaatccaattggggttgttcctatcttttatatgatgacatctggtcaaagtcgtgttcagcaaagtcatactgctatgattacttgtttttcgattgtcgttattttattgatcagtttttatttcggtaatttcattttaagttcgttcaatatatcgattaattcattcagaattgccggcggtattgtcgttgtgatgattgctttaactatgattaatggaaaaattggtgatcacaaaattaataaagaggaacaaaaagaggattttagcgaaaaagataatattgcagtcgttccgttagctatgccaattttagcgggtccaggatcaattagtgctactattgttctaggttctagtcagagttcatggagcgaatacttatattcgtctattacaatcgcactttttggtttaacttgttatattttatttcgttattcagagccagttatagaaaaattaggtaagacaggatcaaatgtaataacaaggattatggggttattgctaatgtctttaggtgtagaaattatcactaccggcttaaaaaatataggcgttttttagcttcaaagtcatattatccagtaaaaaatacaccgcacttttttatgctaaacattgttttttttcagtataataaaaaacattttttcacaacaatgatggaacaataattatgataaatacaaaatttaatgtaaaaacctttcaggggatgattcttgccttgcaagatttttgggcaagcaaaggttgttccgtagttcagccttttgatatggaagtaggtgcggggacatcgcatccaatgacttgtttacgtgctttgggacctgagccgatggcatttgcctatgtacaaccctcccgacgtccaactgacggtcgttatggtgaaaacccgaaccgtttacagcattattatcaattccaagtggtgatcaaaccctctccggataacattcaagaactttatttagacagcttaaaaatgctcggtttcgatccaacccaaaatgacattcgttttgtagaagataactgggaaaatccaacacttggtgcatggggtttgggctgggaagtatggctgaacggaatggaagtgacacaattcacctacttccaacaggtcggaggcttggaatgtaaaccggtaactggtgaaataacctatggcttagagcgtttggcgatgtatattcaaggtgtggacagtgtatatgatttggtatggtctgacggtgaatttggcaaaactacttatggcgatgtattccatcaaaacgaagtagagcagtctacctataatttcgaatatgcagatgtaaatttcttgttccattgtttcgaacagtacgaaaaagaagctcaatacctaattgatttggaaaaacctcttcctcttcctgcttacgagcgtattttgaaagcggctcatagttttaatctacttgatgcacgcaaagcgatctccgttactgaacgtcaacgctatatcttacgcattcgtgccttaaccaaaggtgtggcggaagcctattatgccagtcgtgaagcattaggatttccggggtgtaaaaaataatgacaaaaccgattttatattttgcccactggtgccctgacaccgaaccgtttgtcgctgaactagaacgcttgggtgtggaatttgaagagtgcgacatcacaaagtgtggtgcaaatcttaaactttttttacgtcttcgtgactaccacccagcctttaatcacgccaaagccaaaggctatataggtattccggcattgttgttagaaggggataaagtggtgttggatttggcagaattagaagggatttggggtaacgtatagtagaaatattgctcggttattgaaaaaataaccgagaaatttatgttacagatttagaaattatcataatcaaggagaaaaaatgaaatatgcctttatcgactatgaaaacctgaattcattagatggtttagcattacaagagtatgatcgaatttttctctttatttattccaacattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatattttatccaatgatcagggctatgatggtatttgtaactttattcaacataaaaaacaggggcggatttgtcatggaacaaacggcaactagaaattttccagtaagattggaaagcttaaaaaacaatattcgtagccgttgcggtttaaataatattgatataaaagaggctgaaaaattggttgttctagtaattgataaattgctttcagaaaaagtaataaaaattgctgataacaaagtaagctatcctaagcgatagcaaagagtgaatttttattatttatgccactttcttttaagcagaaagtggctaaaaatttaaatactcggattgaatttttctatcaaaatgtgagctgacattctgtattacatgaagatctacatcataattaaaccaagtttattattttgtcatgtcgttaggaaaatgatgatgagcgtaaactggcaaaagcaatatccgccgcttgtaaagtgcggtcaatatctgcgtcagtgtgtgctaatgacatgaaacctgcttcaaatgcagatggtgcaagataaacaccttgttctaacattttgtggaaaaatagattaaacttttcaacatcacattgaattgcttgttggtaagaggtaacttcattttgtgtggtaaagaagatgccaaacattccgcctacataattgactacaagcgggatattatgttgatttgctaagttttttaaacctaatgccaatttttttgtgagcattgctaaacgttgttcattaccttcttttctcaattcatttaagcatgcgattccggcagacatagcaattggatttcctgataatgttcctgcttgatatacgggacctgtaggtgcaatatattgcataatttcttttttgcctccaaaagcaccaacgggcatacctcctccaatgacttttcctaatgttgttagatcaggtgtcacttcatagtaagattgtgcaccgcctaaggctacacgaaatcctgtcatgacctcatcaataataaatagagaaccatattcattgcaaagttgacgcaagccttgtaaaaaatcctgtttcggaaggatgcagttcatgttacctgcaacaggctcaacgataacgcaggcgatttgatcaggatattgttcaaaagcatttttgacagattgaagattattatattcgcaagtgatggtatgtttagcaaagtcttccggaacaccgggagagcttggttgtcccaaagtcaaagatccggagccggctttgacaagcaaactatccgagtgaccatgataacagccttcaaattttaaaattttatctcttttagtatagcctctagccaaacgaatagctgacatagttgcctctgttcccgaattgaccattctcaccatttcaattgatgggactaattgacaaattagttccgcaagttcaatttcaagcggtgtaggtgttccaaaacttagcccattttctgctatttttagtaccgcacttaagattgatgggtggttatgacctaaaatcattggtccccaagaacctacgtagtcaagatattgttttccttctatatcgaaaatatacgcaccgttggctttttctatgaacactggcgttccgcccacacctttaaatgctctaactggagagtttactccgcctggaataacttgttgtgcacgagagaataatgtcgctgaagttgtcatgataaatcctttaatatattgttaaaaacacactttgtattctactgtaaatgaagataaatttataaaaatatttataatacgaggtttttcgatgttcttttacattatttattatgcacccaattgctcaacaaattgaattagttggtaaacacattatcgtaagcatcataaaggtgcaattcttccttatttcgtaacgaattttgtcattccgttgggttaagagaatgaaaaaagaacgcagagaataaaatcatgaaatgtaatatcacttcataaattttattaaaaaaacgtcagtttggataaaaaattatctaataataaaaaaaagtaaaaaaatgctagacaagtaattgtgaaactcttaatatacgccccgcaacgacgcgatgagcgctcgtagctcagttggatagagcgttggcctccggagccaaaggtcgcaggttcaaatcctgtcgagcgtgccaggcgacgttatatcaaatgtggtggctatagctcagttggtagagccccggattgtgattccggttgtcgtgggttcaagtcccattagccaccccaattagtcggcgagtagcgcagcttggtagcgcaactggtttgggaccagtgggtcgtaggttcaaatcctatctcgccgaccatttttgttctttaacaaactatcagacaaactgtgtgggcacttgtgagactgtattaataagagattaaaagagtaagataagtgcttaaactagagaaattcatagagaaaagatggataaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggactaaaggggtgggactgtgaggccacctgccatttgatgagcccaagtgggattaggtagttggtgaggtaagggctcaccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggctgttcgccatttaaagtggtacgcgagctgggtttagaacgtcgtgagacagttcggtccctatctgccgtgggcgttggagaattgaggggggctgctcctagtacgagaggaccggagtggacgcannnnnnnnnnnnnnnnnnnnnnnnnnnnngcattgctgggtagctaaatgcgggagagataagtgctgaaagcatctaagcacgaaacttgccttaagatgagttctccctaacgaagagttagtaagggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaagacttgaagtagaggcttgtttttttattgaagaagagatagagacgggatataagagagaggaatttaacttggcggcgatagtgcggtgggaccacctgaccccatgccgaactcagaagtgaaacgctgtaacgccgatggtagtgtggggattccccatgtgagagtagggcaccgccaagttttttatgagtttattttgttagtttatttatattagtaagctaacaaaacaagtttttttgcgactatagctcagttggttagagcaccaccttgacatggtgggggtcactggttcgagtccagctagtcgcaccaaatgaataaatcaatgtaacgcatagtaacgcatttcaacccaaaagccttgtataacaaggcttttttgctatccgattaacgctagttgcgtcaggataaatcacattgaccttgaataatagcacccattttagtacccacgcattataattagtttgattattgagtactaaaattatacaacctcttaaaaatacacaagtagaaaaggcaaagtatataacaggaaacagggcagaactaaacgactgtgaaggcttatttttacagctatacccatccgtctcaaaaatttggcgatttcgctataatcaccctgtaacacaaaaaagaacaaagctaaccataggtaactaccctgatttttctattgctcaagcaagagcaaaaagagaagagtttaaagcattattagcataatacatagatccacaggcatataacgagcaacatagaacagagcaagaacagagcaaaaaaaggacgcttttagcaattgccgagtaatggaaagataaaagcgtgaaagagatagaacctctaacaatggctaaaaattgggagcgattaaataatcattggggctgtattagatcagccctaaattccacaccattttcgcaatgtttttaactgctcttttggtgttccaaagttaaaccgaaattcacattccttcaagaacaaaggaaagttttttcggtcaattccattatattttcggagtatccgtttggcttgactccaaaagttttctataccgttgatgtgattttctttcactgcaaacaactccgaatgattgatgcgttcgtggtgaaattggctcacatcaagagcatcatagctacgatatgtatcggtataaacccaactgtcaggcttgattttccttgtgattacaggcattatcgtttcggttttggtattttctaccaccaccgtaaatacctttccctgtcgttttaacaagccaaaaacagccactttaccggttgctccacgccctcgttttcctttacgatgaccaccaaaatagctttcatcaagctcaatctgtccatcaaaaacatcatcggcttcaagggctaaatgatagctgatgacttcacgaattttacgataaaacaaggcacttgaatttggattgatacctaaaatattagctgctgatcgagctgtcacttctaacacaaaaaactcaaggagctttttctgtatagatttctttaatttacaatgagttattttcatttttatagactagcatacttactaatctaatacagcccctaatcatttatttcctcatttgggggcttactcaatagagaatattacccccccttttttttttactaattaatgctgtcaagcctctttacgagcaaggtaaaaatggcactatgcaccgcattataaatttagttaatcaagtattaaattacgctgttaatttgggtgttttatcatttaatccttgcctacaagctagcaaagcatatcacaaagaaccaccaaaaaaatcaccctgctattcattattctgaacttcccctattattggctgattttgaacaatctaacagagagctattaactaaatttttatttaggtggtaattgttatcaatggtacgccctgctgccgaagctgtttcagtggaatggagtgaaattgatttaaataaaaaatttggtttattatttctaaagaaaaaatgaagaaggttagaacggggagattttcgcattctgtacccttatcaagacaaatgataaaatattttagagcaattgaaaccaataacgggacatcataaatatgtatttccatcattcacaaaacctaatcaaacaatgagtaaagacacaattgctaatgcgttgcgtgaaataggctatcaaggtaaacaagacgcccacggattaaggacgattgcaagaacttatttagaagacaatatgattgattttagacttgctgaaagttgtttagctcacaagataggggataaggttagtcaggtctataaccgtgctgactacatcgaacagcgtcgcccaattatgcaactttgggggtatgtgcaccagaattttttaatcaatcaaattgacagtaaaacctagaaaaatcaatgtttctaggttttttatttatcaatatcatatgaatatcgattcattctacttattttggcaatactaacgaggatgatatagtagttgtggtcagtcctctgagtaaagctgagtaaaggcaaaatatgaattattttcatagtcttggcaaaaaatctcatttttcttaaaaaatttttatggtttaatacaccattattctaaaaatgagaaaaattaatatgatgacaacatttgaatgccgtgtacatacgcttgaatttgatgaaaattaccaaccagaaatgcagagtacccgtttaacgaccaactttgctaaccttgcgcgtggcgaaaaccgcaaagaaaatttgcaaaatgtcattgcaatgattgataagcgttttaacgatttggcaaactgggataatccaactaatgatcgttattctgtgaagttagagatcgtgtcaatagatattgatatggagggaaaaggtaaattttttccagcactcgaatggctgaaaacctatgtcatcgaccataaaactggcaaaaaaattgatggtatcgtaggcaacaatttttcgtctttcgtgcgtgactatgatttcagcgtgttgttgttagagcataacagaaacaaggaagaatttaccgtaccgaaaggctatggtgaattgcatggcaagctattcaaacatctgttaacttcctctgcatataaagaaaaatatagtaagcctccggtgatttgtttaagtgttgcaactactcgtacttaccgcagaaccacaaatgttcatccgattttaggggtggaatatcatcaagataattattctttaactgatgagtattttgcgaaaatggggttatctgtgcgttattttatgccaccaaaatctgttgcaccttatgcgttttattttgatagtaattcagatttattgaatgattacaccaatcttgaattgattagtacaattgctacaatggaagctttccagaaaatctaccgtccagaaatttacaatgctaattctgtggctggtcaagtgtataaaggtagcttgacttatcaagattactctgtgaccaaagtagaatatgatcgtgttgagcgtacacagcttgcaatcaaacaaggtaaatatactgaagcacattttattaagccatataaagcaattttagatgcttggatggctgaaaaataaatcaagacagtatttttatttgatacattcgtagggtgggttaaattccgcccctacacatttatttaggaaaaccaaaatgagcaaaattcttctcccaacctctacagccggtagtcttccaaaaccggtgtggcttgctgaacctgaaaaactttggtctgaatggaaatatcagggcgatgaactttttcaagctaaaagagatgcactattagtttcccttgctgaacaagttgcagcagggattgatattatcagcgatggtgaacaaactcgtcagcactttgtgactacatttattgagcatttagagggcgtagatttcaataagcgtaaaacagtgcgtatccgtaaccgctatgatgcaaacgtaccaagcgtaattggtgaagtttctcgtccaagctccgtatttgtagacgatgcaaaattcttacgcaagcatactgataagccgattaaatgggcattacccggtccaatgacaatgatagatacattatatgatgcacattacaaaagtcgtgaaaagttagcatgggaatttgccaaaattttaaatgaagaagcgaaagagctggaagcagcaggtgtagacattattcagtttgacgaacccgcgttcaatgtattctttgacgaattgaatgattggggcgtggcagcattggaacgtgcagcggaaggattaaaatgtgaaactgcggtgcatatttgttacggttatggaattaaagcaaatactgattggaaacagactctcggcagtgaatggcgacaatatgaagaaagcttcccgaaattgcaacaatcgaaaattgacattatttctttagagtgccaaaattcttgtgtacctatggaactgattgagctggtgagaggtaaaaaagtgatgcttggtgcgattgatgtagcaaccaatatcatagaaacacctgaacaagtagcggatattttgcgtaaagcactacaatttgtagacgcaaaaaatctttatccttgtactaactgcggtatggcaccgctctcacgtcaagttgcaaacagcaagctcaatgcgttaagtcaaggtgcggcaattattcgagcagaattagcaggttaatctgatatggtagaagtctctcaatttaaagatgcaatggcacaacttgcctcagcagttcatattgtgaccacaagtggtgaaacagggcagcatggctttacagcatcagccgtttgtagcgtgaccgattcaccgccaacattgcttgtgtgtgtcaatagcaatgcacgtgcctatgagcattttataaaaaatagggtgctaatggtgaatactttgactgccgaacaatcttctttatcaaatgtattcgcctcacccttaagtcaagaagagcgatttgctaatgcttattggacaacattggttacaggctcaccgatgttacaggatgcactgattaattttgattgcgaaattacagatattaagcaagtcggtactcacagtattttgatttgtaaaattgtagctattaaacaaggtgataagaaagaagcgttggtatatcacaatcgttcttaccgcattcttaaatgaaatttgtaaataaatcgtaagtcttataccgtaacttataagtcgataagttacggtgttaatttgaaaaaatcgctatgattttattaactttcttagaaaatatttgaaacgattgtatgtacgtctataaagtaattgttctcttttttgatgtttaaccaatagttgactgttatgtagttctttttctaatagagctagtgagaagagttggtaactttgttctaaatattgcattgcttccaatttatattgccttcttctatttaacttgaaatcagacaatgtagtattcggcatttgagtataagataatattttatgtaaagggatgagttctaaattgaataaaaatgagatagtttttggcaaataaacagaatgtttattttgttgtaactcatagttaccaatcccaaaatctgctttcataaattttaagtggtaataggcgaaaatattttttctaatatttctttgactaatgtctaaaaattctgtttccttgttttttttaaagatgctatcttcatctactctaaataaacatagatcaccatataatccacaataaggtgagctgtaagaaatataaagttcaccacaatgatcaataatattaattcctgaaacaggtaatacatcattgggataattttcttttaagtctaggtaagtctgttttagcaacggtattttttctgcagaaagaattaaatctccgtctatttttatagcccatttcttcgtagtttgacttaatgaaaagttatagtaattaatcagactatgaggattatcaggttctaaatttttatagttatcactaccttgaggataaacaacaggtaaatagtgaaaagtttttattttattaggataaagttttgcgtattgttcagcaatttcacccgtattgtcttggcaattattatagacaatcaccaattcatctaataaaggaagccagctttcaatagattgagcaagaaactctccttcattacgtaatcgcataaaaccgcttaagccttcagaacgagtgttggcttgaaaacgtgaaaaatcaatggtaggatttttgactgactgactgactgactgactgactgactgactgactgactgactgactgactgactgactgactgactgactgactgactgactgactgactgactgactgactgactgatttagcatattgttatttcccgtctttttagagagaaaaatggtggagaatttccaccatttttcaatattattcacttctagtgactttaatcgccaactcttccaaagctttttcattagcaagactcggtgcgtcagtcattaaacaagctgcggctgttgttttcgggaatgcgataacatcacgaatattatctgttccggttaacaacatcgttaaacgatctaagccgaatgctaaacctgcatgtggaggcgtgccgaattttaaggcatcaagcaagaatccaaatttctcacgctgttgatcttcatcaatgcctaaaatatgaaatacagtttgttgcatttttggatcgaaaatacgcactgagccaccacctacttcataaccattaatgaccatatcataggcgtttgccaccgcacttgtcggatttgcttctaattgctccggtgtgaaatcttttggactagtgaacggatggtgcattgcagctaaattaccttcttcatcacgttcaaacattgggaaatcaataacccaaagaggtttccactcatctaagtgagttaaacctaaatcacgacctagtttcaatcgtaacgctcccattgcgtcagtagcggtttgccatttgtccgctccaaagaacaaaatatcaccgctttgggcagaagtgcggtcaaaaattgctttgattttttctgtcgttaagaattttccaattggactttgtatgccttctaatccagcgttgatgtcattaatttttacccaagctaaccctttcgcaccgtaaataccgacaaattgagtatattcgtcaatttgttttcgagtgatatttataccgtttggtacacggatgacagccacacgaccgtgcgagctatttgcagggtcgctgaaaacgttgaaatctatatctttcacaatatcagctacatcgactatttctaatggattacgtaaatccggtttatctgaaccaaagcgttccattgcctcttgccaagtcattgtcggaaatttgcttaaatcaacgcctatggtatttagccataaaccatgcaccattttttccataatttcacgcacttccggtgcagtcataaaggaagtttccacatcaatttgagtaaattccggctgacgatctgcacgcaaatcttcatcacggaaacacttcacaatttggtaatagcgatcaaaaccggacatcatcaatagttgcttaaacaactgtggtgattgcggcaaagcataaaacttgcctttatgtactcgacttggaactaaatagtctcgtgcaccttcaggcgtagccttggtaagcattggggtttcaatgtctaaaaaaccgttttcatccatataacgacgtacaaaagcggtaattttggcacgggtttttaaatgttgagccatttcaggacgacgcaaatcaagataacgatattttaaacgctgttcttctgtattattctgattaaaatctaaaggaagtacatccgaaacgttataaacagacaatgctttagctacaacttccacctcgcccgtcgccatatttttattaatttgattatccggacgagcaataacctcaccttcgattttaatacaaaattcattacgcaatgcactggcttccgtcaatgcttcttgatatttcggatcaaaacaaacttgtacaataccttcacgatcacgcatatcaataaaaattaaaccgcctagatcacgacgtttatgaacccatccgcttaatattacttgttgtccaatatggctacggttcaatgcaccgcagtaatgagaacgcatcataatgacttcctttatatctgaaactactgaaattagtcgacgaattatagctgaaatctcgctcatattgaaagagtggacggaatttatttgagtgagacttaaacttcttctaaaatgaccgcacttttttacacttttttagatgaaccataaaataatgaataaagattgtatttttgctgcacccattgaaaaactgggagattttacttttgatgaaaatgtcgctgaagtattccctgatatgatacagcgttctgtccccggatattccaatatcattactgccatcggcatgtttgccgaacggtttgtgacggctaactcgctagtgtatgatctggggtgttctcgtggtgcagccacgttatctgctcgtcgccatatcactcagcctaatgtaaaaattatcggcgtggataattcattaccgatggtagaacgttgtcgtcaacatattaacgcttatcagagtgatattcccgttgaaattttgtgtgatgatattcgtaatattaaaattgaaaatgcatcaatggttattttaaatttcacattacaatttgtaccgcaacaagatcgtcaattattactggaaaaaatatatcagggacttaatcctaacggaggattggttttatcggaaaaatttcgttttgaaaataaaaaaatggacgacttgcttattgatttacaccatcaattcaagcgagccaatggttacagtgaattagaagtaagtcaaaaacgcaccgcacttgagaatgtgatgagaacggatagtatagaaacacataaagaacgcttaaagtcagcaggtttctcccaaatagaactttggtttcaatgttttaattttggctctatggtggcgataaaataacaaaaaaacagcctctgaagtaagaggctgactaagtttaactatgactttcataagcgagtagcgtattaaacataagcatcgcaacagtcatcggaccaacacctcccggaactggagtaatgaaactcgcctttttgctcgcttcatcatattgcacgtcaccgactaacttgccatcaactcggttaattccaacatcaataacaattgcaccttctttaatccattccccagggataatgtgtggcttacctactgcaacaactagaatatccgcttggtgcacatgacttttcaaatctttagtaaaacgatgagtaactgtaactgtacagccggctaacagtaattccagtgccatagggcgaccaacaatatttgatgctcctataataacagcatgttgtccgtacagatcaacgcctgtggtttccagtaatttcattatgcccaaaggcgtacaagcacgtaaggttggaatacgctgacaaagacgcccaacattatacggatgaaaaccatcgacatcttttgttggggaaatatgttcaatcactttagtagaattaattttctctggtaatggcaattgcaccaaaataccatcaatttgcggatcttgattgagttgttcgatgagagttaataattcttgttcggttgtttctgccggtaaatcataagattttgaatagataccgagttcctcacaacttctacgtttacttcccacataaacctgagaggcaggatcagcaccaactaaaataacagctagtcctggtgctcttttcccttgttgaagataatgctgaattttttcagcaacattaaatttaatgtttttagagagttcagtacctgaaataatttgtgcgggcattaattctttccttcaaatttgatctcaaatgagcaacataacaatcatttaaattattgaacatgaaaaacgctgctattgtgtcaaaaaaaagcgagaaatgtaagtcaatttgagagaaatttcatcaatcaaataaaaaagtgaaaaagtaattgactgtttatgaaagaaaattataatgcacctcatcggcgagtagcgcagcttggtagcgcaactggtttgggaccagtgggtcgtaggttcaaatcctatctcgccgaccatttttatatttattattttttatatgcgcccttagctcagctggatagagcaacggccttctaagccgtaggtcattggttcgaatccaatagggcgtgccatttaaatccttatatatcaagcagttatcactcaggcaataagttttaaatgtgtcacagatttgctctgtgccgtaaatgtgccattaaattcaaccttgtttgcgtgctctagcagatgatctgcatttaagtgagcgtatttttttaccatttcaagcgtttcccatccacctaattctttaagtgtgaagagaggagtgcctgcctgaacgtgccaactcgcccaagtatgacggagatcgtgaaagtgaaaatcaagcaaaaaacattttctagctgctgcattaaatgctttgcggttaatgtcatttagcttattattctcacgcccaacaaacacatattttgcgtgtttgccacgtaatgacttaagcaataagattgcttcgtcgcttaggagtagtgatcgtgctttacctgattttgcaacatcattagtcacgatcgctaccttacgcacaaagtctattttatcccaagtcattgtcagtatttccgtcctgcgagcacctgtcattaatgcaaacgcacaaatggctctcatccaatcactatttagcttggcaagtaagtcttttgcttgctcttttgtgatccatctaaccctaataggcggttctgcatttttgggtaggtgtgggactttgtcgaccaacccagcctgatgagcaagatttaagatccgtaaaatagactgtatatacttgtttttggttgagttggtgagcggtttgtttgtgttcatattccgtgtagggatatgatttaggatttcttgagttgttaaagagctaagcacccgtccttggaatttctcacgccaatatttagcgtgtcgtttttttgtgcttgtatcttttagaccttctgcagagcgtacatacagtagtaacgcctcttcaaaaatatattctggcttttcgttaagcctatctattttccacgtttctgctttaagctgatcgtggtaatgttgagcttccttttttacagttgtgccagcagagcgtctaattctcttaccgcttggggttgtgatatcaacccaccatgggccatcttttgttcttctgtagatcgacatagtgttacctcttcgaccgacaaagctaatcggtcgctattatttgctcgttttttgagtaaatcaagatctgatttatggataagccaacgattagatcctttcattctaaaaaatccccagtcatagagatgatttctaaccgcactttgactaaggtttaagtgtttcgcgacttgttttatwgtkagwgyttcytccatatttcctccaaaaaataaaccctagcggtggctakggttgttttaaataatctactagtcgctccccaatccatcgcattacagggactgccattgagttaccgatagctttataacgtggactatyggggcaatcatcaatckgtttgttgcgatatgggattagtgtccaattatcaggaaaaccctgcaatctctcgcattcggttggagtgagcttgcgaataatagatggttggcaaatgcaaggtacattatttccacctgtcccmwttcttgcttttaatgttggtgatattggtttatctgcaattcgcacagcctcttcgcctttgacttcgaataacaccttatactgtgatgcagtcattgtaggtgcgataccaattcctacagtgtgctccttgtctttgcagattattggtggatacgctccataagagcattcaccaatatttttggcagaacttttcccctcttcttggctctgattaaaatcccctcgcaagctcttttgctcaaaaagtatttgtgcgacacttcgccttctagcacttgccacaaggaacactcttttacgtcgttgggcaacgccgaagtattgagcattgaggactcgccaacagatagtacgggctgaatgcacataaccagagtttgtccatcttgcccctgaaggttgtaatggctgacattcttgagccagtccagccaaaaagtgtccgaatgcgttgtccttggtagataagacaccttgtacattttcccagacgagcacgcaaggcggttgtccattttgatttctgacataatctattgcctctaaaatatggattaaagctaaagttaaatttcctctctcgtcatcaaggctttctcgcttgcccgcaaccgaaaatgcttggcaaggtgtacccccaactaacacgtcaggggctttgatttcacgatttaggattttttcaggcaaggcggtcatatcgcctagatttgggatttcagggtatcgataagcaagtaaagcggacgggaaaggttcaatttcagcaaaccataaagrcttgcctaagccttgccacgccacacttgctgcttcaattcctgaacaaattgagccgtaggtgaacattgttactccaataaaaagccctcaaaattgagggcgttgtgtggttattcagtttcggayggtagcggtgggatttccgcaaatttatcaatttrttctaattcgaaagtggcattaaattcaggtatgaccyagacatatacatattcattccytaattcatcacagyaatytggttctctccttggtttacgytctgcgtctatgaatgttagatacccaattattttrgtattatctaaatgtggtatatttacataaacaggttgattgagttgaggcaatgagtttcttacactaatccatttactcatttttaacatccttaggcggttgtgggagtggttgccartgrgtaayttcaaaaagtttactactcatattaaattctccatcaacaagttctgacaaagtaatagatttatagtctcggcttgcatttttgaaatatacaagcactctttcgcctgattttggtagtttatctttaacactaatccaaccgttaatctctaagatttcaggtgagttgataatttcatcaatctcatcgtaatatcctgactccttttcctctttagttaatggtctcttacttgagattgcttttcccaaaataacaccataaactgcaaatggtaggtaatatccttcataattttcaaattcatccaaatcgttcgcaaaatcgtaggcatcaacagcactgtttaaacaactctgttttgcttgttccagcgtttcgtgcaactcaaccgaatgaatatcgtttgatacatcaatcgaaaagtattttttattattcatattattctccttagtggtgttattgattaatctgtaatcttaatttcacgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattaccgaacacatagacctcgccactcactttagcgtagcctctcaccttagcgttctctgttatccacgcacagtcgcctataatagcgtcttcatagacttctgcgttatctcgtacgtaggtgtcatcacgtacaaccgcgttgccatataccaaagccttgtcacataccacggcgttaccatgtattctagcgttaccgaatactctcgcattgccatacactcccgcattgtcatacacccaagcatttccatcatgacttagattttcttctttctcaatataaccgcccagcttacccgcctttatatcaccaaaagagattaatgctttaattcggtagagtgttttaccattctgttgaatagtatcattttgaagaagttcgtattttttttgaacttgtctttcatattaaatttccttgtttgttaacgtcgtttgtcggattaattttttcaatcaactcatttccgaaataagctgatcgtagtatttttgtgcggcacttacgcgttcaatgaggctagaatagtcgcatagagagtgtttttttcattattccacaaacgtcattcttttgtagatttctcttactcgttcaacatcttttgcacaatattgagctacttcgttgattttgccgtcttggatgtattgccatacttttgatccgtcaatatcgcctttttgttcaatatcaagtactttgcataatttgtcgagggaaacagtgtttccataacctgcccattcggtcatggtgtcatagatattgtgacgaagtggggtgtagcaaggtttgatacggttgatcacagagcgttgaaagataaagcgaccatcaaatttagtaatgttatgtccgatcataagtggtgtagctttagtgatatgtttgcgtaaccagtcgttaaattgagttaaaatgcgagtttcccgatctggtaattgccaatcttcgcaatagaacaaaacaggtgaagtgtcatcaactgctgcaccgataactacaatttcaccaaatgcaccatcaagagcggtcttgttgacgacttcgggtttattttctgctaaccatttttcaattgtttcagggtttttgtagttagcaggggctttgagattttcacaaacatagtttttgatttcgttgttttgtgttgggattgtttcaatgtctaaatagattttcattttgttgctccttgttagttttttttgattttagtttgcgtaaaaatcggttgatgttatcgcaagttttaaattgagaatgtggactgaatacaccgtgttttgggttttcccattctggttgtttgtcaacatctagcattattaacctctcattgtttgtttccagtaatcactatcatcattctctgctttcgcataaaaaattgtgccttgatcactttttctatagcttgttgtcttgtttcgataatatccatcatcgcaccgctcccaagtgcgatatggtaatcttcgctattgtctaactcatcataaaattggctgtaaatttggctgtttggatcttgtagttccatcaaaacttcggtacgcactcgtttaaattccaaactatcctcaatgtcttcaccaaaatatgcttctgccatatggtcaaaatgtctatctaccgcttggattaattgcatatcgttcattttttctttccttttaaaagtagcgtttttaatttttcaatagaggctaagtcaaaggttaatacgctgtgatgtcttgtttggcgatctaacttaatagataaattaccctcttcatcaaattgacaatgttgaaccttgtgtattgttttacctcgctcgctcttgattaccgcacttaaccttggatttttccattcaatagccagaacgccctgtttctcctgaagcataggtagtttctttatcccttttaattcttttgtcatattgatgatgtcgattgctttgtttgtcgctttaatggcgatgatttcgctcaccatcggattgcaagtgcggtactctctcacatcatctacccaaacttccccataaaattttttactgattggattttgtaaaatttggattttgtagctattcatcttcatttcccctccttgtcatactgtgcttgtagttgttcggtgtatttttgcatgtagtctacatcggcttgggtaggcggtggcggtatatcgcccttgcgtgaaatccattcaatncttgccatttcttcatcgtargcaagctgtgcwtckggggagagttttccatattgagcaaacgctgggtgaaaataggcaaagacaagtagagtgctaagaaaaatagccacgataagaacgataaagccaagccatctgtaaaatgagattaataaattattcattttttgtttcctttttggtcaatttactgaatttaggttgagtgaaaccgccacactggaaaagtgcggtcggtttcctttgaggtttaaaatcttggcaatgccaaaggattatgtgttgctaatatttcttcgcctttttgtagccacggattaaactcatgagcaacgtcataagacaatgctccaatatcgtttcgaatgtggcgttcaagtccgagcattaaaaagagttgacgatgaaagatttctgtttgttcagcaagctttttagctagtcgagtatgtttcataatcgcttcgaataactcggcggaaatggtaatttcgtctctatctgcgattttaggcggtgtaataatcagctcgccctctaaacaaattttgtgaacatattcgaccgcactttgtaatttatctgccggtatatcctcaatactttctacgttcatataatgatgaacaagattgtaggcttcgttgtagagtaaaccttttttgctgacgagcatattgacggcattacgtaatcctgtgcggtcatcaacggtggttttgcgttcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagattttatttgtattaaacaagccactttcgacagtggcgtcaagaggttcgaaagcctaatctaaggtaagggctgggattatttcctttcggtattgtattctccgccctctcgacatnnnnnnnnnnnnnnnnnnnnnnnnnnnnnnnnnnnnnnnnnnnnnnnnnnnnnnnnnnnnnnnnnnaggtttcgacacctatgggggaatagtaggttaaatttcttcgtttgtcaatagataaaaatgtaatatttattacaaaaagtacttgcgttaaaatgtaagtagtactacaataaacatatctaaggcaaggtgctttagatacaagaaaaccccgacttgttgggttcggggcattcaaaatggagtttaggatatgttgttcaaagcgttaatcctaattatcctcttaatggtggcaatgccagcgttctaggataatccatcgggggagggcattcccccgatgactccaatcttaagctaacttaacccaaaatgcaaggagttttctatggcaatgacaagagctgaaatcaatgcaaaaagcgataaaaagcgtggtgtgcggtttcagtcttataaacttcacgaagatgtgattgcattgcttgccgagctttccagccaaacagggttgtctaaaacccaaattgtgacgcaaggaattatgctgtttgccgaaacaaaaaaggtcgcataacgtgcgaccaatcccgactttcgtttgaaagtgggaatatcctaaatgattgggcggtggtttgtcaatttagattttgttcattgaattgtttaattttaatattttgtagatgactggctcttcatcaatatattcaactaaaacatcaactaagaaaattttatggtacgggtattcttcatttaatatcattttttctttgagtgtcttgtcttcaaattttactcgtacaggcttttgtgatactgcaggaataatagctctatcgtgtgctttgctttgagcatctgcggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaagccgttattgaacggcttgtagtgcggttatcttaatccgaagtggggcggttgtaaagtaaaattattttgagatagtgtactattttcttgtgttatagtgtactatcttttataataggcgacatcagcacggggctgataacaggacaaagccccacctgttgagatggggctgataacttggagttaagacaagatgaaaaccttacaaatcatcttaatcttgattgtgctgttgttagtaagttcaccagcttactaagcacttaaaaccgatgggggagttcgcacctccccctgaggtctccaacattttaccaaagatagatcctgaaattcaacctaaaatttacttggggctaaacctatgactatgactaacgctgaaaaagttgcccgttccgatgccaagcgtggcattatggctaaaacctataaactgcctcagtcggttgtcgctgaaattgagcagttgagtgagcaatatggtattccacaaaatcaattattgatacaggcaatcgaagcgtttaaacaggcaaaaggggcgtaagcccttttttgctagtcgccgttccaacgcttctaatctgcatactgttttgttgaacttttagtcaaaattgtttccaacattaacacattgacttttatgtttaaatttagtatagtttaaaatctgtatatatgtacagtatttttttaatgttatttttaaaaggagaacgcatatgtctggatttgttgatttaactttagagtctggtgcaagtattactgttagtaaaacggcagttttttatcttcaagaaagtaaaaattcccctcaaactacgttattacactgcggtggaagcgtaacacatcaagtgaaaggaggttatgaagaaattagcgttaaattccctaattttattcaaactgagctttctgatggggtgaaagttggcattcatgattacaatgtatcttgcttggaagaaaagcaaaacggtattcaagtacatggtgtagcagtttattttactagcggtcctattgggttggatgtaaaagaaaattactcagactttaagaagaaatttcatcaaatttaattcatatttaaccgcctgtttgggcggttttttgttggttttatgccgcacttttggttaaagtgcggtcaattttagctaaatttagatgtatatatatctcaaaaaggaatttcatcatcaaggttatctgctaatgggggcggataagatgatgaggttgattgcccataaagttgttggtgggcttgataattttgttgttgatcttgttttttgcggtcgtctttatctttaatgtgttcaataagccatttaatccgttcagctggtttattttcaagatgctctgccaaggttttttgggtgttgtggaagaatgggcagagaatctgaaagccgtaagtgtctgaaccgtcttgtttggtgcgaaggactttttgcagcattaatccaatatatttgccctctaattgtggtgcgtacgctttgttgtctttaaattgtcgtgtaagttcagccactctcgtgacccccataattgcttgtatcatgttgtgtccgctttgtagtgggctaccgtctttaccttgataatagattgagaggtaatttcctcttaagccatcttttgtttcaacagtcagttcaagggataatgcaccactttgagactgaacatattctgcactgataattctgcaaatatatgctcctgtttcagcgataaaactggaattaccagctttgatcgcttgttcttgattgtaagtgaatattgtttgtgtcatttttcgtttccttgtgttggtttgatgtcgtagtaatcgcaaatcatttcatcaacggcgttgaggtcgttttcaatgaattgcgtttcaaataatcccatagggctttttactgggtcgttaccgttgttttgcgtagagaattggaatttccagtcatttacttgtgtgcgtaaacagatagtaaccatgccttctagcgtaattttttcatcaagcattttgccaatggttttgattttggttttgccaaatggatcggtttcgacgtgcgataaaatatagatccgcttgttcattggtagctttaatgcggtattaaataccgtccatgctttttcgccaatgtcagtaaatttgtcatagcctctttctttcgcacgtcgcataaattcatttgccataatgtattgataatcatcaatgataatgatttcacgcggtgttctagtcatagccttgcaaatagtttcagtatcatcacagacaaaaatagatccgctagggttatctcttgtaatgggttgccattctttcgccctaaatggaagtggtttgctaattgactggataagaagtgttttttgtgggtcgaggtggcgtaggctagttgatttgcccgaaccgctttcccctaaaattaaggttgttatgctcataatattcccctaaaaaaaaccgcactttaagtgcggtggattttgatgaagtttagttgttgattaaagtatcttgtatcgttgtagtcttcgtttttggttagagtgttgagttttgtttttattttttacttctaacagtttgtcaattaatggaagcgtgtctttaatcgctttttttgtccaattcaaattcaattctacagagttgaaaatatcgcttatgataatcggtttgatttttttaagtaagaattcaacgctttcagcaaagcgagtgaataacatccatacatcgatcatcttttttagttcactttcagttagttctaaagtgaatttgggttcaggcattggtaatttaagttgtgttgtttggttttccagttggtttaaaaacgcacgcaaaaccacaagatgaaattgtggcgaaatccacgcagcgtaggcgatgacgatttctttgcaggcgtatgtgccaatgccatttttgacaattaaaactgagctgtgagatttctcacaggttggattttcgctttcaatctctgcaattagagcttttgtttgatcatttcgcaaaaaataagtaggacgatgttttggatcgtttccacttgccctatgaagatctgctaatgaataaagattatttaaagtacgaattgagttattaagaattgctaaattagtcattttgactgctcctattggttttctgaaattgaccagttctgacactggtgccgagaggttcagaaccctccaataggttagggtggacgtattccccgaaggtattgtattagtcgccctctcgacgttgcgagatatcggcataaaaaaagatcgcttttggcgatctgcttactaccgcctattggaaaaaggttctgacaccttgaggcagatagtaagataaaagggtggggtttgtcaataaaaaagcctgtgttgtaaaccggctattttgttattttcttttttgttttctaggtttatcgtatttaatcatttcacgatttgcaccttttagtgttttcttcacttctttaatattctgttcaagttcaagatgttcaggtgcaatcccactattttttatcatcatatcccgaacttctttaccaacttgagaagcggtattttgtaatgcatttaaaccacgtacattcttacttttaattcgttctgctgtttgagttactctaaaccagttacctgcaagttcagtatttcccataaagtcatataaagtccctttttcatcaggcatctgtttatgacgtttaagttcagctaagcccatattatacataccacggaatcccgcatctttaaaaagtccaaagtgttctggtaaaagcccagcacctttcgcagaagctgacataatttgttctccatcagctaattttttacggatttctaaacgctgaatagcgttatcatcaatcgcattttggactaatttatctgcaacagcagccaagattgtttttgcttgagcaacttgttcttttttagaatctgcgtgcattgtgataagaaagcacgcaaaacgagagagtttataacttttcacctctctaccttgaaagacaatgtcaatctgcgagaagttatccattatgtcaatttcaaggttggcacaagacgacatcgctttattgataacgcttttgaatgagttccaagactcgtaaccaagatgtagcataaaatcgtgggcgtgccagtatctaatgccattttggtgagcatcattttcaaagagttctaaatcaaattgttctgccattgtttacccctgtaaaaaaagccgttattgaacggcttgtagtgcggtcatcttaatccgaattcggggcagtgtcaaataaaaagtttattttatataaaatatctcttgcatatcaattggtatattgtataatatacttgtttttgagatggttcaaaaatgagaagagcggctcaaaccgctcaactaatggagatagaaataatgaaaaccgtacttttcattatcatcttgttagtgttgttattggtaagtcctaacgtttactaaacactaacccggagggggaaaggtcagatgttcccccaatggctccaatcttaagctaacttcatataaaaggcaagcgttatggctcaaatttccgaacagttgcgtaagcgtaaaatagagacagcacgacgatttaacgataaagcccttgcagaaggtaaggcacggcgtattttaatgcaattatcagccgaggtagccgatgaatttgacgctatctgtgccgaattaggtatttcccgccctcaagcaatcaaggcattgtgcgagatgtatcgggcaaaaggggcgtaagcccttttttgttgtctaaaaaaagcccctatctctaggggcaaactcacattacggatttcatatattgattatgtcaaaagtaccgttttaaccactcggcgtgtggaatggtgtagtgcgaccattcagaacggctctcacaaggaaaaatctgaaaaaacttgtaggagaaagagagccgtgttgaatggttgcctttctttgacctgtaaggctcaggtgttgtcacgtttattttttaacgagtatatcggttactctcttgtgcctcactatgcacgcccagatttcgcctaaacctattattgggttatgtctttgtcttactaaagcgtaagcataacgctgtggcaagtggggggttttatgggcttcctcttgtgtttccactctgacttgcttcaccatcggrcaataataggttytatccaaattgtrtcgagatgaaatgaaagcmycttgkggatttttagartatratrgrtctaaccttgtgcytgctgatgatgttcckgaaaacgttccttaaaattgattttttcatcaaatggaatttcttcrcayagytcaccatcayaggtarcttgggacattgycttgattttttctttggcttmttcggcrttgttggcrtatacatyacagcaycaacttgtgccttgkarctgatagcgaaaaaggtattttttcattrttttttcttccwtaggtattccttatgmratttgaaacttacttagacaaacgccatgagtggcgttggcgtttaaaggcaagtaatggcaaaayaattgcagatagcggtgaaggctataagcaryrttytgactgtttrcatggrattgatttggtacgacaaaccaatcagttyacagakattatttgycttgragacgataaacattaaytccaaagctccgcaaggggctttyatttcatctcgatttttaamgagcgttccttrttacaggatttatttttgccatttccaaccgcacttgagattaggtcgatactctttcagtttcgtgcgataaatcgtcgttttatccatttttcaacggtcaaataagtgcggttggaaatggcatagttttggtttgatgaggttattatgtacctaacgttcattaaagtaaagaacaaaaagtacaaatttttaaattaatttatgtactttaagttattttattgatttnmaaagaaatttatttttgaaaaaaatgattgatygcttgwtttttgarcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcagtttgaggtaaagaaaaaaccgccgaggggcggttttgttattgatgctcaataacatcaagaataattgcatctttaattttttcatcaagtattttggcattaatactcagtttaaccggttttctttcccattctgcttgcattagcaataatttgtttttattacccgctaaaaactgatcttgaacaatcgcctcaaatacagcctcagtgttcacgttgcgaattcgtactttaaaaagttctgggtctgaagagtttacttgttcaagtctataagttccatcaagtcttatttcggttgaacgacggcgtgcatttttagtaagctcagtcgttatttcaggatctaaaatactattacctatttcgacttctttcacaccaataaatgatttaaataaacacgtttttgcatcgtgagcctgacgatcaatattttctagaacagcattttgtttcacgatattagcaataatccctgctcgttttgtttcctcttgcgacattagttgtaaagattgaaggtgctctttatcttcatcttttttaatttcagcaaggcgaacttcttttctattatctaaaaatcgtttaattcctgagcttgttgcccaaatagcagcactaccaagcacagttattgcaagtgttgttgcatccatttttgtagccaattgccctatttgtatccataaaccatcaaaattaacattcaatagcgacgaaccacgctcaacagtaatttttaactgcaatgcctcacgttcttcttttgataatttctgcgtatcaacatcattatattgaattagacgataggttctattaatgtaattttgcatttctacaaagcctttcattatgtttggcgtgaggctttgctcaaacttttcacccactaagcgaatactcagtggaggtagtttttgtagatctatattatcactaattaaacctgtttcgatataatcctcaagaattttaaataatttatcttcagaattgataacaatattattcatttcatttaattccatattttaactccgttcttacaaacctataaattagatttctgctgtattcagtttccgcattgctgtggcacaagatttatctttcagtttgcaaccctacaaacagctcctatgctcaacggctttgccgattatttttattttatggtgtttactgcttaacgtgccgaaattgtcgttgagaggaacaagtttgaaatgttttctgccgtgttcgtctacttcgccagtttctttgtattgtttgaaagtggcttcgttatcttcgttgactgcgacaacaaaatcaccgggggcgggatagatttcgggatcgattaataccatatcgccttcttggaagcgtggtgacatagagttgccgacaatttttaaataaaaggcatttctaccggctttaatttgcgaggagatcatttcgtattgggtgatttcatctgtattactcagcaaatttacttcagtaaagtaacccgcttgtactgggctgagtagtggatagtaaaaggatttaacgacttctacaaatgttgcattcttatcaaaatttttgacatcaccaaaagttagccattcaggggtaacactaagaaaatcagctaatacataagtatttgcagtagatggcatggtttctgcattaaaccatttactcacagctttaggtgtcagttttaatatatctgcaatttgtttgccacgtcctttgtttggaagccctttgttcttacaggctaagtctaatctttccgcaaacgcttttctaatttcttcttcattcattcttttttcctctttgtactgttagttcaattataaaaaaaacttgaagtactttcagttatattttaatatgtacatttagttcagtataagaggtaaaatatgacatcactagtacatattcttgatttagcagggatgcctaaagttgcagaatactgtggggtttctctgcgagctgcctacaaatggcgtaaagccaatgccttaccaagaactgaatatacaggagaaacaaattatgccaatgcaatttctgaagcgattaatggtcaattttcttctgattttattcgtgaagttggcagacctaagcctgctgaaacctaatctaccccaagaggtatgcaaaggctcgcaaggaattaacaaaaaaatgcaagggcgattgcggatttgatttttcgcaaatctagcagtcgcactacaggaaaaataaaaagccactgttggmgcagtggcaakgattaggaaaaatcgctatgaatattaatcykaaygaaaaacaaagtcaatcgcagaatgcgaggattttagctcatytraaaaawggtgrgmgaatmacytcrcttgawgcrttaaatcaatttggctgtttgcgtctttctgctcgcattaaagatttrcgtgatygtggtcatgaaatccatgcrgaatttattgaagtgycwartrgyaarcgtgtgaaacagtattttatggaggcatttcatgagatttagtcaacacttacgacaattgggtcaacctattgcgtattatccaaaaatggcaaaacccttaggcggtgtgactgctgcgattttattttgtcagcttttctattggcaagataaaaccgacaatccgttaggcgtgtacaaaacacaagctgaacttgaacaagaaactggattaagtcgccgtgaacaggaaaccgcacgcaaaaaattagttgaattgggtcttttaatagaaactcacaaacgcttagaacatcgtatttattttaagctggatttagcgaaatttgacgacctaatggctaccatttttgaggtagaaaatccaacattacccgatggcgataatgtacaaccccgaatggcggaaagcgacattcgggaagtagcaaaaccgccattcgttaatacaaagactactacagagaatacaaacaataaaaaagatttaactaacgttaaatccaaaaaagccacaccaaaaccgaccgcacttgctttrcttgctgaatttggcattaccgatcagcttgctgaagattttattgaacagcgtaaagtcaagaaagcaccgattacccaaaccgttcttaaccgcttgcagaytcaagccgatattgccaaattgccacttgtggaggtagtggcgattatgattgaccgcaactggactggctttaatgccaattgggattggaggggcgaaagccaattttcaggtaaagccgagccatcaagcaagcctaaattcagcgatgaaaacaccacttggtggcaagggcgaaccattgaaatttatggagatacgctgtgaaaacctttgaaaatgcgaccgcacttattggcagtrasccgaattattctgcacccgtagcacaagggcaaaaacaggaaattcctgagcaagtagcgaagtatgttgaccgattatttgttcgtttaaaagccatttttccgggctggaaagcagcgtttaactctgatgcagagtacgaggaagcgaaggctacttggttgcaagcattggtgaataatgggattaccaaagcagaattatttaaacgtggtttgcagttagcagaacgctcagaaagtccatttttgccgagtgtcgggcaatttattkcttggtgtaaatcaggcaatgagtttgccgatgttggtttgcctagtccagaagagttgttgcaacgctatcacaaatttcgtgcgagttgtgaggagccggagaattatccttggcaaagtgcggcagaatttcacttagtttgtcagttaaaacgggcgatttatcaggagaatttaacccatgagaagttactgaacaaagctcaktcgttgattaaagccatggcaaaatatctcaaagaaggcggtcaattagcagcaccaaaggcaaaaaaattaaccgcaccgaaagagccgaatttaacrcctgatgaatgtacaaaatactttgcagagctacgyaarcarwtgystrgcrtkacaaaaacggtttagyaggagatgataaaatgmgtkttgamaaaraygcktaccgcacaccwcgttatgtttttaattggttagaacgtcgtttttattggtttcatttagacggytgtgcgaatgarcataatagcttacgtcatcgttggattggcgarggtagcwskgtkgcaacagattttttagcagatgatttgtttgatcgcttaattgatgaagtggttgaacaagcggaattattacggattttcgttaatccgccatacagtaatcctttgccgtttgtacaacgtgcggtwgagytgatgaaagcgggttaccttgttgttatgttgttaccggcggataaatcractaagtggtacaaagtcattcaggataatgcaacggaagttatcgatattatcggcggtcgaattaactttattcatcctgaaacaggtgaggaagtcaaaggcaataacaaaggctcaatggtggcagtgttcgatccgtttattcaaggatttgtaactcgtcaagtgagcttggattttgtgaragagtgcggtatttcatagtgagatttttcaatggctaaataccaaatgatgaaacttgcaggaggggtattttctccattgaatgatgctgaggctgaacgcttgaaatcttttcagaataacgagcaatatgaaattgaaattaaaagacagcgtaatccagcatttcatcgtaaggtgtttgcgttttttaatttctgttttgagcattggtgtggtgagcattccgattggaaatttcaagatgaaatagctcaatttgatacgtttcgcaagcatttaactgtattggcagggttttatgttaaaacgtggaatttaaagggtgaggtgcgtattgacgcacaaagtttgagttatgccaatatggagcaagaggaattcgagaaggtgtatcaggcgttgattaatgcggcaattaaacacgttttcaacaacactatagacgagaatgtgattaatcaattgtattcgttcttttaaaattaagatataaaaaaccgcactcgaaagtgcggtgggttttaagtgagtttagcaggctttcagtggcaagcggttttcctgtttgaggcttgccagcattcgtttaattgtcgggttggtttctttgatgttctgcttgcagaggttgtaattaaactgtgcggagcgttcttcaaagcggtcaaaatcgaacccgaaggctttaagcaggaaatacacgctttcttgaaaacgggtgaactgcatccacgtgttgatgaagttgcgtaattcgctttcggtgaagctgaacgtgattgagggttcaggttccggcaaggcaaactgtttcggttttagctgatatttccccgttttacggatttgcggtagcacttcttcaaagacccagttttgaaactcgaccgcttctggtttgtttgagcggaaaatcacacgataaagatttggctcattgataaagatcatttcctgatcaccacttgtggtaggggtggaaagtttttccaccccctgcggattgaatttaaatttgcttacagagcgattgcataagccaagaacagatgcaacatcaagcaaacagaaaaatggttcagaacctaaaacgtgaatacgtactgggaaagatttgaagttgaaggtagagatttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatttgaagttgaaggtagaaatttgagttgacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgtgaaaaatatcctacgcctaacagaggagctkrycaagcgtaggggattgattawgccgataaaatcttatcggcggcaatttgagccaagaaaccgctacggcttttgtactctttatgcgttgccacaaattcatcaatacgcttgatgagataagcaggcattgtgatgttgattttttcggctttgcctaagaggtgagtaatatcaacatcaacgaaaccgaagaacatatcgtactcggtaaagtcgggattattgcggtgattattgattgaggttggtaatggaacttcttcgcccatttcaaccaataattccaaatgccctttgatggcttctttggcgttagcataggcttcttccaaagtatcaccggcagaatggcaacccggaatatcagggacgataacgccgaatgcgtgagtttcatcgcccggttcgattgcgattggatataacattttatgctcctgtatagcagggctatttcagccccgcttgtttaagtattgaatgttccgttcctttttttaaatccttttcaggatgttggacggtaacaatcccttttttggttggatgagtgaagtggtggtggcttcctgttgtgtgatggaatttccagccgtccgcttcaatccgtttaataatttgtttgctactactcacattgctttgctcctctgtattgctaatcaatgtggttattatacctataatttagggtgacgcaataaaaatgtagattatacccacaaattttaatttaagtgatttaaaaatgaacaaataaagtaaaggaggttgaaatggtttgttatacggtgtggataatgatattggctttgataggttgaaaatgattaaaaaagtgcggtcaaaaaaatgcaaggtttgcggaaatgcgtttaaaactaatgatagttttcgacgatggtgtagtcctgaatgcggggtgaaattagctcaaatggcattggtgaaatctcaagaaaaggagaagataaaaagggaaaaggaagaaagagcaaagattaaggcggttaaagagcggttgaaaagtcgatctgagcgtttaaaagagttgcaaggtgtatttaatcgttttattcgcttgcgagataagaatttaccttgtatttcttgtggtcgctatcatcagggacagtggcacgctggacattatcgtagtgtgggtgcttgccctgaattgcggtttaatgaggacaatgtgcataaacaatgcagtgtatgtaataaccacaaaagcggtaatgtgattgagtaccggattaatttggtggctaaaatcggggtggaaagagtggaatttttggagagaaaagaccatttaccgttaaagctcgcagatgatgagattaagacgttaattcaggtttataaggcgaaggtaagggagttgcaagatgcacaatartctamaygattttaagaaaaaatgcagacaatggggatattgggcyacrcctagaattggtacrgaatatccgagyatawcrccrtcaatycckrttccrcaggataartattgyggtaaagtcgayccaattaatgaagatcttgcaatggagtttgaacgytgtgtgttaattatgcaaaaggtaactcgagaactttacgatgttttcatggtgacttatgtttatcgcttgccgttgaggaatgaatatgacagrcggagaattttggtgagaaaagggatatgtgaaaccttggatataagcraaacmacktataraaaatatctttayacsgctgaaaymtcattaaagcttatgttaagtcaaaataggtgtatttttgttgcataaacctccctcaaggcggtttattcttaccacaaactcacaaactcacttacaagcagcttctcaacaattcgcaaacctatcaaaattagaccgcactttaaaaggctgaaaaaacaaaggggagcctgacgctccccactacacgattaaaccgacttgttatcgcccttgtttaatcgaccaactgtttttcaaattggttttacaagcccctttcgggtacggattggattttactttaattttaatgctaatgcagtacagtttttaatcacttggaaatcagtaccgctaacaagtggcgaaatataatcacgcttaccgattttataacgatctaatcgggaaatcgagacggtataaatcatatcgcatttcgcccagcactgaatgtttgctttatcaggcaatggattgacaggcaaagcatagtgatatttttctaagggttgaggttctgttgtactgagcggaataaccgtgactaattctttattccgtttatgttttgcaatgacgacaacaggacgaactttcgtcatttccggtgattgaaactttgagaaatcacacattagcaccgatttttcttttggttggtattttaggctcattgtacttttattgatatttttcatcgatcctacattaccgtaaaaagaagatcaacaggaagcaagccacgctttgaaaccgtggtaaaaatcttggaagcctttaaccttaaattagtgccgacaataaaggcattgtaagttgataatgattaatttgcaaaaaaccttgcaaargwcgccstaaaagtgtagtatttcagctatggtgcggttaagtacacttatagcataaataaacattttttacagccctgagcagamatgctyggggcttttttatgggatttttttggtgatttattatgaaagatatggggacgcaaagttatttgtggtcgggtctcagtgggtttatcgcttggctgggcgaccagcaaaatttgatgatgataagcctttctatcgggattgttaccgcttgtgtaaatctatatcaacggtacaaggaaagtaaacttcgtaagcgtgaaaacgaacgtgcggaagaattacatcgacttaaaatggcaagattacaaaaaggattagatgatgagtaagttggttaaagttggtggcatttgttcggtgtctgccattattgccttgatgatgttgaattttgctgacaattttcgcacaagccaacaagggcttgagttaataggacaggtagaaggctgtcgccgtaacccttatcattgcccttctgatgtgcttactgtaggaattgggagtactgtggcaagtagcggggcaattgaaccgcataagcgttattcagatgcagaaattgcaaagcgttgggtaaacgatattcaagcggcagaacgttgtgtaaatcagttcgctaacggtcggctaatgcctcaatctgtttttgattcagtggtttcaattacgtttaatgttgggtgcggtaagttatctcgctcgaccatgtttcgtcaagcaaatgaaaaagattggagaggtgtttgtaatgaatttccaaaatgggtttatgcaggcggtaagcgattacgaggacttgaaatacgtagagagaaagagaaagcgttatgtttgtctggggtaaagcaactttaattgtgttattgggtattttgggcttgggtgttgcaatgtgggttcaggtacagcggattgatagcttaaaagccgacaacgcttctcaagcccaacttattattcgactgactgaacagctgaagatggagcaacaggcagtgcaaatacagcaagagatagccaataaatttaaagtaaagatggagcaaagcaatgaacagcttaaaaacaccttgcaacaagagacctgtgcaaaagtggcattgcctcgtgatgttatcagtattattaaccagttgcacaactccaccgcaaattgaatatctttctccrccmcwwgcctayactattccttgtgaacgntctgcttttcaggggaaaacttatggtgatgcaattragcatttaatyaargtmatrgctgaamgrratttatgtgcaagtcagattgataarattcgrgaatggcrgattgagaatgcacagcattgagattttaatgttaatggtttaattatggcgaaaaaaaactggaaagcgttgcaaattgaatatctaaaagcaaatgccaaaacaggtattactgttaaagattggtgcgagaagaaaggattaaagtttgccagtgcgaaacgttatataaaaaagcctgaaaccatgtttaatcagtctgaaagccgccaaacagtacgtaaagaaaaacaagcagaagcaataattcatcaagaaaactgcgaattaaattgcgaaacggacgaaaaaactgcgaaacgaaaacaacgctcttatgtgaattcgcagaccgctcgaaagcatggtggttatgctcgctatttcaaagacaaatctgcctttgatgttgtagtggattttagccttaaagatgaaattgatttaatgcgacagcgtgcggtcagtgcggttgaaagtatagaaaaattcaccgcacttttagccaatgccaacaccgcagaggaaaaatcactttatgcgaagctgattgagtccactgacaaagcacttgaaagagcggtcggtcgcattgagaatttaaatcacacggacaataacattgcaaatctcttaagccaaattgaattacgtaaggttcagtctaagaaagtaatggcggaaacagaaaaacttaagcaagagatgaatgcgaaaacagcgggacatcataagctcgaataccttcaggagtttaactaatgcgtattgtttatcgtgcttcagaaacgtttaaaaaagtacatgcctcaactgcgttggttaaagccattcgtggacctatcggtagcggtaagtccgtggggtgtgtgttggaaatgtttcgtgttgcacaacagcaagagccgaatgcacaaggcgtgcgaaaaactcgctgggcttgtgtgcgaaacacctatcctgaattaaagggaacggtgattaaaacctttcaaacgtggatacccgagcaaatttgcccgattaaatacgatagtccgattacaggtaagatgaatattaatcatcctgatgggaaaacacgtattgaagcggagtttttgtttctttcgatggataagccaaaagatgtgaagaaactaatgtcattggaattaactggtatttggatcaatgaagcacaatttttacccgtttcactggtaacagaagcggttacacgtaccggtcgttatcctgaaaagcgggttgaagaagggtttatgggggcgacgtggaacggtatgattatggatactaactcgcccgatgatgaccattggtggtatcagtttgaacaagggattgatgaggaaactgaacagcctttaaagcctaaaggttgggagttttttgttcaacccggtgcattaattgatattacaggcatgcctttagcgacattgtctgatgagataaaatgcaatattgaacaaggacattatgatgattatttaggacatcgttttgtggcaaatcccatcgcagaaaatgttattaatcacaaaaaagggcatgggtactggtttgataatattcaggggcaaacattaaactggatcaaatctcgagtgtgtaatgaatttgcaaccgttcaacaaggcaaacctgtttttggcgatcacttcaataaagaattacacgtttcaacagaaaaactggtaccagtcaaaggttgggaaacctttatcgggttggattttggtttaacacctgcggcgattatcggacaaattgcacccatcggacagttgcggattgtagatgaaattgtcgcaacaggtatggggattgagcgttttattacggagcaattgtcgccattgttaagaagccgatatgcagagtgtgctattcaaattataggcgatcctgcaggtgttcagcgagcacaaaccgatgaacgcacatgttttcagttgcttgaggaatacggttttaatgctcgtccagcagaaagtaataatacgacagcaagacttgaagcagtgcgttggtggttatcccgtttagtaggtaaaggtcagccggcaatgttgattagtccgcactgtaaaacattgattaaaggatatgaaaccggctatgcctatcgtcaattgaatgtgagcggtgaggaaaaatatactgaaacaccggataaaaatcggtattcacatccgcatgatgccaatcaatatctttgtttaggtgcaatgcctagcctttttaaagagcaggttatcaatattaaaacacatcaaccactaagcaatattacaggatattaacatgtcagaacaacttgcaaacgccattgaaagctatggacgaacacttcaaggcattttacaggagcaaattaaacaacgtcagcccatcgtgcaacgttggacgaaagatatgtatcaataccgcaatcaatatgaaagtagtgttgacacagggaaatctaaagtctttgtgggatatacgagagcaaaaaccgatgcgtggtcggctcagatgacagatatgttatttccaagtgatgacaaaaactatggtatttcgccaacgccagtaccgcaaattgctcatcttgctaaacagcccgacagccaagatccaatgcaaatgcaacaaatcaacatggcaaaagagctaatgcaacaagccaaagagcggtcggaagctatggaaaaattgattgatgaccaattggcagaatgtgactatgcctctgaggctcgccttgccttgcattacgccgctgtacttggaacgggtattttgcgaggtccggtagtagatacaattgatgagcgtatttggtctgatgatggaatgggtaattggtccgcacaaaccaagtctaaaatagtgcctaaagtgcggttagtgttaccttgggattttgtgccggatatgaccgcacctacattaaaagactgccaatttgtctttgaacgttcttacctcactaaaaaacaattgcaaaatctgctgaataacccttattacttagccgatacggtgcaagccttaatcgaaagcgaggcaagcgaaacgcatacctccagcagtgatatggacggttatttagacacccttcgaaccttatccggtttagaaaaagcaagtaatgataaacggtatgaggtatggacttatcatggtggcattcctgtttctgtcttagagcaagctaatcaatctttagaagaaggctatgcgttggaattaacggaagagcaaaaatccgaaaaagcggaaattgacggcgtgattgtaatgaccggtaatggcaagattttaagtgtgaatcttaatccgcttgataccgcagagtttccttattcggtgtatacatgtgaacctgatgtcgcttgtgtatttggtttcggtattccttatttgtgtcgtgatgcacaggaaattcttaatactgcttggcgaggaatgatagacaatggtgtgttaacgattggatcgcaaattgtcgtcaatagttccgtactttcacctgtcgacaaaagctgggaaattaaaccgaataaattatggcgaaccaatgatagagtttctgctaatgcaagttttgaagctcaacgagcttttggcgtgtttaattttgaaagcagacaacaagaattggcgaatattatccaactggcgaaatcctttatggacgaggaaagcggtttgccaatgattgcacaaggtgaacaaggtcaagttacgcctacattgggtggcatgtcaatgctaatgaatgctgctaatgcggtacgcagaagacaagtgaaagaatgggacgaccaagtgaccaaaccgcttatccgccgtttctatgaatataatatggcgatgaatgacgacccgaacatcaaaggcgatatgcaagtagtggcaagagggacgtccgccttgttggtcaaagaaacacaaacggcacagattattgatattttccaaaaattcggcaatcaccctcaattgtcttatgcgttcgattggtatgacggggcaaagaccttaatgcaatccatgagtatgggggcgaaaacgatgctgttatcaagggaagattatgagcagaagctccagcagatagaacaagcgaatgcgacgcaaccgcaagatccggaaattctcaaatctcaaatgcaaatgcagttagcacaacaaaagcaacagcatgaaatgcagcttgaacagatgaaattgcaacatgccatgcaaattgagcaaatgaaagtagccatcaaagagaaagagcttgaagtaaaaatgatggaaattgaaatgcgacaacatcaagagcaagaaagaatatcacttgatgaacgtatcaacagtgtcaaagtctcttccgatatgcaacgagaaaccagcaagcaaatgttagatatgaagaaattccaagcggaaattgctttaaaacaacaacctctcgccaatccgacaggaaactatggtgtagagtaattattgacattgtagaagttcagtaattccaaaaaaaacaaaccccaagtaacggctaattacttggggtttttcattccaaataaccggaatataaggaacgaagatttatggaaagtttaaaacttatcctatcaataatcaaggagtttagaaaaatgacggcacaattatctaatttacgcttttgggggatatggctgatcggtttcttaatcgcattatccatttttataaatgcggtaaaatggtggtannnnnnnnnccaaaaacaaaccccaagaggtgcaaactcttggggtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcttgcccctaattttctgaaagccgttgcagattttatcttgacgatgaaaaacagttagagtagnnnnnnnccatagagcttcaaaactcttttgtaacaatctaaaaaattcaatctatggacagggtggtgcggaaatatccaatacccacgccgtcgttacagcggttttgaacaccctgtccgcccacattctattcaaaaggaaatgtaacaatgtcaaattctactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctaaacaaacagcggcaatccgcacccgacagcatagcggtttttttatgcgtaaaatttgtgatctgtttctttctctcaagaattttgattacgcatacccaaaatttatctatgtcgagagggcggagaatacaatacccgaaaggggaataatcccgaccgtctgtttgcggttttcgaacctctcggcaccctattgaatagggaaaactaaacttcgaaaaaacaaacaggagcagacttatgtctaatcaaattactactcaaactctttctttccatggttcagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaacaagaataaagagaaatatgggtgtttcgatatcgaaacacctacaaatggcggtatgcaatcaatgctctgtatgccaatcaaaaaactcaacggctggctgtttagcattaaccccgaaaaagtgcggtcagatttaaaagaaaaagtgatctgctaccaagaagaatgttttgaagcactctacaactactggcactttggcaaagccgaacgcaaaacgactgttaatgaacgcaccggcttacgcaatgctgtaaatatgcttgttagcaaaaaaggcttactctacaacgaagcctacaatcttgttcatcactatatgaatgtggaaagtattgaagatatccccgcagataaattacaaagtgcggtggagtatgttcataaaatctgcttggagggggaactgattattgactcaccgaaacaagatgatgaccttgcagataatctaacgttaacctcaatgtggttcgcactttacaattgtttagatttgttagggcaacttgaacaacctttgcgagcaattggctcgcacttcggttcaacggcatacactcacgctacggaatatcgccatacattacaatttgcgagagatgtgctaatgcaaaaattagagggcgtagagattagctcttgggaagagccacactaccatttagcattgaaaacaatgcgagcaagagaatacccactgagaagaggtattaatagacgataatttagcaaaaattcacaaaccagaccgccaaaagtgcggtctttttttatttatttttaaggaaataccatgtcagactttagcctttccaatgaagaatttcagtatttgcaaaaaaacatattaggtatcgcaccaaatgcaacaggttcaagagaacgaggacaatcggatgtcgcagatgagggttcttcgtccattgatgtcatagctaaccaatacaaattgccggaagagcaaggtttttttgcggatgtggttgatagcgttcaaatgggggcatggcgtggagcaggtgatttagcccgaggtataggagctttatttaacagtgaatggttaaacaaagcggctgattatgcctattacaacgcagaagaaaacaaagcgaccatgtcaagcaaaatgcaagaagccttgggacagagtgcatttgatggctggaatgaagaaactggagaaggcaaaggtttactcaatatgtattggtgggcgggcaatttgggagcattgctcggtgaaaacattgatacagttctcaccatgggagcgggtaaacttgcgacaacaggaataaaagcaggcggtaaacttgccggaaaatatttcagcaaagaagtcgcagaccaagtagggaaagcagcggtaaaacaagcaagccgtttcggtattcccgctcaatatcataaaaccattgcctacacggcgatcgcctctgctatgtcggcgggtaatcgtgcaaatcaagttcgagaggaattatcgcaaattagcgataatgacctagctcaacataatgactttcgtattgcgtattgggatttaaaagagagtgatgaagggcaaacactttccgaccatgaaatttttgaacaagcaagacagcagtattacaacaaggtcggacgagatgcgatactcaatcctcttgcgattgccgcagatattactgctaatgctgttggtggtttagggggtggtctttggggtctaccaaaggtaaataaatggctgggcaaaccgacacaaaatatcaaagagggtgtattaaaaggagcgttcattgaatctgcaacggaaggcttacaaggtgcggctgaacaatatgccatcaatgacacagcaagagattattacgatagtgaccgcagtttaactgagggcatgagtgaaaatattgctgatggcatggtattaggtgcagggttcgggggtatgacaggtggctatgaagctatgtctcatcgcagaaccatgaaccgtgagaaaaaacgccttttagaagcggtgaatacgggtgatgaacgagtggatgcacaaattcgttatcaagtagaagcctataacaaaattgccaatgatttagatgaactgatttcgccacaaagaatacaaacattaaatcaatttggcttacaagcggttgaaaaagctaaacgcagagagcaaattgaagcggaattaagaggggaaacacaagctcaagcagaaaaacaacaagcagagcaagttcaaacagtaaccgatacaccttaccatcaacgcaatttagccgatattcaggcggaatttatccagcatggtttagatgaaaatgattttaatgattttctagaagccaacttgcaacaagcgacagcagatttacaaaaacttcaagcaaacccatttaaaatggggacagatttgcaaaaaagtttagcagaaaagaaagcctataatgcaaaactggcggacacacaagcaagagtagactactggacacaggcaaaaaccgccccaaagtttggtactgaggctactcaagcagaaagtgcggttcaagcagagagtgaagttcaaacgcaagaacaagttacccctgatgaattgaaattaagccgttcagccccacaagaaacgcaatcattctatgaaaccgaacaaggattargtgggaaagagggtgaatttagtgcaaacaatgatgatattcggtttagcttgaatgagcgtgcagatagtgattttgctaaagcggttgatgtcgtttctcggggttatcctttatctcaacatgtcaaagtcgggacaactcctgaagttttgaaaatgttgggattgcctgatgttagagtgactattagcggtgaagtgttgcacaaagtaatgcaaggaaaacacaatgttacggctacaaccttaaaacaattgccaagtcaaatcaataatcctgttgcagtaatgaagtctgaaacacagcctaacggctatgtggtactgaccgaattgatagagcaagtgaacgataaaaataaacctgtgattgcggcgttgcatttaaaacaaaccaaacaaggtttagagttaattaatattgccagtgtttatggtagaagtaactcacaaatccagcgagcattagagagtaatttgctttattggaataaagcaaaaggttcgcaatttgtgactgccttcgggcttcaattgccttctcatatgcagtccgctacgaacctttctgtcgctaatattaaaaccgaaactgacttaagtcaataccaacgctcaacttctcgttcggcgatgaaaatagaaaaaggcaacttgttagaaatgacctctcgcgtatcaactgcggagatttctagctcatcgcctttatctagtatcaatgataaacgccttttgcagattttgcaacaacagactaaatctttcgactttagccaagaaaaatcccaaattgcagaagctgtaggaaaaggactatcaaccgcattttgaggtggtgcattcttctgaactaggtattaacgacccgactattgaagcagcttacaatacccaaacaggtaagattgttattattgccgacaatattcgagccaatgacattttaacacgtgaagagcgtttaaaatgggtagcgtggcatgagctggcacaccgagggctacaagtgcggttcggtaaagagttccaagccttratggaacaagcagaccgaaatacgacagtgcgagatttagcaaccgcacttcaaaaagaccgtgtagaacttcgaaataatcgtaccttggcgatagaagaagcgatagcrgaactgcacgcygcttataccacaggcaaaatggaagagytraaaagccgttatggtctagttgttcctcgtggtagagaaataagcctaaaatcttggtttaraatyacygctgaacgcattcgagagtttatggtaaaacttttcggacgtgaaaaagcaaatcgttttagtcatgatgacttgcttaatttgttgaaagacattcagcaaagtgcrggcggcgatatamaygaagcggataataatacacgytattccttaaatgaagatccaaattcaagttttgctaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcgtttgtctcgttcaagcacttatcaatcaggcgataatatttccgtattagaactttctcgtggtggaaatattcaagcaccaaaatggacggataagttcagcacgcttcaagccttgaaagaaacttttcatcaaggaacggcaaaattggacgaatggtttgctgatagcttaagaccggtaaatgattggatagacaacatgcagtttagcgatcataccagcaataaaagtggtcgagaccatgaaaaacgccgtttaaaagacgcaatgtatacagcaaaaggaagacgtgatgccttaaattctgagtttgaggttcattatttgaatccgattttgtcgaaaattgcagaaattgctaaacggtcgcagggtaaaatcaacgaagaaacggcaaaaagaaaagccggyttttgggtttcagcacgttattccattgaaaagaatatggagctattgagcattgatgaaaaagctatgcaagaggctcaaaaagccttagatgacgcaaaaatcaatgggacagtagaagatattcgcaaggcaaaaaatgcctttaattcagcacaaaaacactatcttgaccgtaaagcggcagtatggaataaagactttaacaacaagcactttaaagcaggagttgccggcggttggtctattcctgaagccaaagaaattatgcgtaatattgagcgtgatatttcgcttagggatttaacggcaattggtgatttaattgcggagttaaaccaagcacggttagaaattgattataagagcggtcgcttaacagacactgaatatcagcaatttaaagcgaaccgtcattatgtgccgttgacaggcgatccgaatgcacaattagacgacatggattttatcgcaggtgctggggcaaattcgttgaatattgccaaggataaaaccttaaaagggcggacaaattctgaggcggaagatgctattgacgcaatttggaaagcggtagggaaatcgacgacttatgcagggtggcctgaatttaaagggaaacttgatgcgttgcttgaaacggaagtgagtttgcttgaacagcaaggctatagcaatgtggaagcacaacgcctagccggtcaaaatttagggattggcaaacagaaaatgcaaggactgacacgcagtagcgataatgtgttaattgcgagacgtggcggtgtgtattatgagtacagtttgccgaataacgtcattgctgccctgaaaaatgataatgtggagcaggcaaatgatttcctgaaagtgttatctaagcctacccgttggtatgcaagaggagtaacgcagtggtcattggcatttgctccgattaatatgctgagggatacatgggaaaaatccgaatttattcgtgtgcaaaaagtatacgacagacaaggtaaattgctcagtagcgataaaatggatcaaatcggaagagcgactgcactttcacccctaacaaatcctgctatttgggcagcaacgaaacgctttgcttttgggcaagaattgcgtgatagtgtgttagaagaaaagctattgaaacagctactcaaagagggggcgatttcaacatatggtacttatctcgaacgcacagaagcggatttactcaaacgcattaagcgagaaaatagcgtgctggggagtaaaatagacaaggcaatgggcgtgattgaaagttataatcaaactttcgatatggtttccgcactttctgcttacaaggcgttagtggataatggcgttgatagtaaacaagcagccgcaacaacattagaactgactaactttcgtaagacaggttcgaaaatgcgaggtattaaagccttgtatatgttctctcaacctacagtcatgggagcggcgaacttaattcgttatctttcaacgaagaaagggcaaatacgttttctgacgtataccgcaggaatgatggcactttatagcctcttgcgttctatggatgatgaggacgaggcagggaataaaatggatcagctgggtgatattacacgttttatccctattccaataggcaatggaaattatattaaacttcctgtggggtttggtatgcctcaaatggcgtggaattttgctacaaacattgtgaaaggtgcggtgtctgatatttcctttatggaggcaggcgtgaatatggttacccatgccacgaaaacctttgcacctgtttcgccatcggagatttccgctgtgaaatacccgttggaaaaattggcactaacctttacgccaagtattttacaaccgcttatgcaaaatgcgttaaatcgttctgcttttggtagtcaaatcacgacaaattttgttcgccaagacaaactcaaggctgaacaatccaagtcgacgaccgcacaattttggaaggatttagcgattgatattcaacaaaccttaggtcttgatatgcaccctgaacaaattaagaatttgtttgatggatatagtggtatgttaggttcattgaaggagctgaatacgtggcttgtggaaaatccgaaccgtgagcaattggggcgtaacacgagaacattgttcattaatcagttgtatggtgcaggtaatgaatttgcggtgcaatctcgttattatgaagcgagcgaagaagtacaacaagttgctaaggagtatgcttatcgaaaactcaataaacaattggatagggaatggctaacgcctgaacgccaagagttaatcaaatggcatgagtataacttgcgaaccatgggcaaattacgcagtgaaaaggcacaactcaccaaacagttaagagcgggaaaaattagtgcacatgcttatgagcaacgcctcaaacgctacaatgaagcggtaaactcggtacagaaaaaactgctgtcaggttatcgccaaatggtagggttaagcagttattgacctgtaaaaaaagcaaataaagcctgtgttaaacaggctttttcggcgtgtaataatgacttgctcatttctttttaatagattaaaatctataaaaaagataaataggcaatgtaatgcaacaagagtggaatgtgattttgcaagatcctgttttggagtggtttaaaacgctaaaacaagaggatttataaaacgatgatagcccttgctgaacaaacttatgaacactacctttcacaattagagcaggagtagcaaaatgagcaaaaactttaaagcattgatggcagaattaccgccggaacaacagaacaaggtgaaagaaatggctcaagaaatgagaatggagctacaactttatcgtattcgtgaagtgctggaaatctcacaacaacaaatcgcacaagcaatgaatatcaaacaaccctcagttgttgctttggagaaacgaggaaatgatgtgcggctttcatcggtgaaacgttatgtggaagccatgggtggagtgttgaatttatctgttcaacttccaacaggaaagacaatctcttttaacttgtagcattcataaagcgacataagatatagttgcctgatattttgcagaaattgccgagttatattttcaatgtaactcggttttttattggggaaaaacatgattcatttgtcctgtgagcttgaaaaagagcaattaaacactttttttactcagcgagtaaaagaatatcaacaagatttaagtaacgagggattaaatgcccagcaatataatattttgcgagggcaaattaaagagttgcaggaattaatcgctttactaaatattcattcaaactgaacctacccaccaagtgcggtaggttttttatttttaaccattcaataagccgctttatgccgctttaggagaaaacaatggaaaatcaagaacaccaagagttcaacgaagatgccgcttttgatgaagccgcgaaatcgctcgaaacaggtgaactgactgctgacagtttgccatctgatgccgagaaaaccgaaaaggacaagcctgatcagcttgaatccgaacctgaacaacaagaaaaggttgaacaggacgatttacccgattggttgcaatctgccacagatgaagtgaaagagaatttccgcaaattgcaagcagataaccaacgttaccaacatcaagcccgttcacaaaatgggcgtgttggagcattgacgaagaaatatcagcaagccgccgctgaattggaacgcttaaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcctgatgcggagcaaattttagccaatccgcattttgcaacatggttagatcgtcaaccggcaggtattcaagccttgtttacgtctgatgatgtgaatgacgctatttatctgctttcagagtacaaaaaaacggtttccgcacatgaagcccgtaaagcaaaacaaaatcagcaactctccgccctttctttaccaagtgggcgaaccgttcctaaaggtggggaagaggtggacgaggatgtttatttcaatcagatcgccgcacaacttgacaagcagcggtctcgttattagttcatcttaaaagaggaaaaattttatgactacaatgacaaaatattctgacattagcccacgtactacagtgtatgcggcagctcaaatgcttaatcatgcagagccgattttggtgttaaacaaattggggcaaactaagcctattccaaaaaacaaaagtcaaaccatcaaattccgtcgtcctaagccatttgctaccgcacttactgcattaacggaaggtgtacgccctactcagcaaaaaatggcgtatgaagatgtcgaggtgtccttgaaacaatatggtgcatggacggaaattaccgatgtgattgaagatacacacgaagatccggtgttaaaagacattactatgctttccggtgaacaagcggcggaaactgccgaaatgttgacatggggtattttgaaagcgggaacgaatgtcatttattcaaccggtacagcgacgagtgcggtaaaagatgtattaagcattaatcacattcgtgctgcggtgcgtaaattacagaaaaaccgtgcgaagaaaaaaacctccattttagatgcgtctattaaatatggtacgaaaccgattgaggcatcttatattgcggtttgtcatactgacttggaggcggatattcgtgcacttgccggttttacaccggtggctgaatatggttctcgttcaccgattgttccgcaagagtttggtacggtagaaaatattcgtttcattacctcgccattgtttaccccacaagaagatgcgggagcacagtcaagcgatgtagtatcgaaaagcggttcaaaagctgacgtgtataacattgttatctttggtcaagacgcctttgctacctgtccgttaaaaggcaaggaatcggcagatatgctgattcgcaatccgggtaaacctgaaaaaggcgatgagttagggcaaaccggctcggtgggttggaaaatgtggtgggcaggaaaagtcctcaatgaggcttggctcgtccgtattgaatgtgccgctaaaaaactttaacccaattatcacaagtagccccatgtaaaagtggggctttattcttcatgaggaaattattatgtcttatccatttatttcatttaattcgacagtagaacaattaaaaacacatttacgtgaacactgcggtatcgaaaaaagcggtagcaaaaaagaactaattgaagcaattttagcgtttgaagaggaaaacggattcgtgcgtccaaataaagacgtggcagagcataccgctcctgtgaataaccttgaattacctttagaaaagcaacgaaaagtgcggattaaaattgcagaaaccgagcaagatcgcagtgatgtttatgtctctattaacgattgggacgcattgattaaaagagggatagaggttgctgtacctgaggcggtgtatgttttattatcaaaagctggcgatcaaacctttacgcaagaaaaagacggctcactgacggaaggtttcagtcctcgctatcatgtgactttattaggttatgaatcatgaattttttagcgttggctcaacgtttacgccaagaaatgaatgattcaggtgaaggacctgcacaagtaacgggacaacgagggcgaaatttagagtatgtgaatgcgataaaagaagcatggcttgatatacaacaatgtcgcccttgggcggttcagttttggcaacaaggctttagccctgataaattacagatacttgaaaacactgttgatacgccgttcattcctgcacaatatcatcttgcaatcgtattttatgcgatgcaatccaaagccatttcacaaaatgcacaagaattgatattgcgaggacagcaagaatgggacaaatatctccatttactttgtcgggactttttgccgacgttgaaagtaggtaggtagacaagctatgttgattattttagaatagccatattattccattttatttgaggtctttatgtcaaatcctaatgctccctacattcgggaaattgttgatcgctcacgcctaattggtggaacagcgatccaatctcaacggaaagatgacgtaaaaaaagccgttttacaggtattttctcaacaggctyaacgcttaaactaatttgtcaaaaaaccccgacttgttcggggttttttcttgcctattttcaggagttccaatgaaactaccgcaaattcaatcacagtttgttgcgataagtgggggtatggatttaaccacaccgcccattgttaaagcaaatagtgaagctattattgcgttaaatgtacaacctaattacggtggcggattttctcgtattgaggggtatgaatgtttagacggtatgactaccccctctttaatgaaccattttcatgtgaacgttaatcacgatgttccacaaagtgcggtcggaaaacagtttttgttaaatgaccgcacttgttatgtgttagcagtgaatgaacgttgtttaacctttgccgtttcgggacagtttgaggttgatgtcggtacaacctttgaccttgataggcaaacctatcaaaccatctcaaagacttttttgaatgcaggagaggccaaacaatggcaacattaccaagcactggcgtttcaagcgggagtggacaatgtgcaagcggtaccgggtgaaaatgccttgcgtggtgttgttgaacttaacgagcaaattatcgcatttcgagatggggaaaatgcttgtgaggtttttttagcgaccaaaacaggttggcaatctgcacctaccacttattttgttgagcttaaagacatcagcaagccaaaagaatttattgacggtgtgaagtttacttccggggaaaaacaaggaaacgtattttctgccgtgttgtcggctgatgatagtagcggttatcttgtggtcaatactgctcttttacctgcagcagaaattcacattaacggcaatgttgcggctaaggtgaaaagctgtgaagcggtcagattgacaaaggaaaaggcgtggacatttatttatcataatttttatggtggtacggaaacggcttatgcttacggttgtaacggtgagcaggtaattgaagttcgtcctgatggtattatcgtaccgattataacccaagcggaaaatcctcaatatattgttgcacatcgtaaccatttatttatcgccttttcagggggacaattcgggcattctttagtgggcaaacctactcattgggcagtattgctcgggtcggaacattttggtgtaggcgatgaaatcacagcactgtcttctaccacagggggcgtactgttaatcggttgtcgccataaaaccaccgcactttatggctcaacacgtgatgactgggtattaaaagatattgccaaggtggggattaaatcaggtacgctacaagcaacctttattccgattgccattagtcaacatggtattattcgtgtcgatgcaacggagcaatttggcgattttaaattaagcgaaacagactccggtcgcaaattgggtttcaaacccattgaaaataatattgtcttttcttccacaaaagccaaagcaaaccaagtgcggttttattcggagaatgcgtttcatatttgcatgatgttacaaccggacggcagtacaaaaagcacctatttcacttatcccgaaaaactaaaaggcgtatggcaatctcatcacaatacgtttttagcttttgatgacggcaaagtctatcgtcaatcggatgactgtttttcttttgcaggcaagccgattgaatggacagtgaaaatggcatttaatcactgcggttcgcctgtgcatattaagagctggaaaagtgcggagttacaagctaccgcacagggtgttttgtctgtgcaatatcgtttcgatttggattataacgctgattttcatgcagtaaatcttgcacgggagttatttgttatcggtcatggtggacgttggaacgaaagttattggaacgattttttatggtcttctcaggaatacgccacacccgtactttatttatcgggttacagtcgaaacctatctttatcttttgccggttcggatttatacgctcctcaatttgaactgagcggcttagtgttaaactatattttaaggagatttcatcgtgtctaaaaaattaagaaattggtacaaaagaactcatgattttgcaccctatactcgtgctgacggaaaagcggtatcagatgaatttgatgcaatccaagcgagttttgaaaaaatgcccgctatgcgagatgacggactgggctttgaagaaagtccggttattcccgacccgacacaggataaccaccctgtacccttacatttgttaaaaacggcggaacaatcggtttatgcggcgagggataaagtcacggagcttgctcaacaagttgcagacaataacgcaacaacggagcaaaatacccgcttagctatccaatccaatgaacaagcccaacaagccaaaacagaggcgagccaatccgccacacaagcgattgacgccaacaaccaagctcaacaagttaaaacggcagtacaaaaagcgaaagagaccgcagtttcttcaatgcaatctgcggaacaatcaaaaaatcaagcaatacaagcggaaaatttagcgaaaaaatgggcgtccaatcctcaaaaccaaatagtacaagaggggaaatactctgcttaccattatgctctagaagcagaaaaatacgccgaaaaagtcaaagcgaccgcagaaggacgtaaagattggcaatttattgataacgtccctatcagcaaagatattaacgacagctcagagacaaatttagccagtgctttttcggttaaaaccgcctatgacaaagcggttgaagcggaaaaaatagcgaatggcaaaagcaattttaaaatagaacaaggcaaagacaacgcagacgactacaaaaccgacgggcattattattttgcgagcggtcagcatttgcccgataacggagcgtggcatrttgaagtggtgagcggtgggcaaactaccgccgtgcgacaaattgcacgcaaagcsaaygataccggcgtcaaaactcgcttttttaatggttyarrttggacagcgtgggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaatccaattgcgtcgcatgaattcctaaagcaagggcgattttttcccttgtggcttttcgcaagtgagatgatttttcatattgactatatgcagattgagtaatatttaaacggcttgccatgtctttttgcgttaatcctaaatgctcacgccacgcaacaagtgcggagcaattattttctaaggcaaaagtcgctacagcaaaaggcacgccactatctaaaggagaggagagttttgcctgttgttttaaccattcaagggtagcaatgggcatgacggcaaaagcagggtgtccgctttcatcatgtaaatattgaatgttagtaagtgcgttcatctcgttttttcacctcttcaatggaaataatattcatcatatcgccggcaatttcaaagaaaactcggtaatcgccaaccctaaaacgataggggtaacgatgattaacaagggcttttacattagaacaaaaaggaaaatgcgttaattcttggcattttcgtgcaattttcgcccctgttggaatttttcttaattgctttaacgctttgggttggaaaataaccgacttcatgaataaagaatataagttaaatataagtttattttagcaaaaacaacaaccaaggacaacacatgaaaatctacttcaaagacggcttttatatgagccacattcacaaaaatattccccaaggtgcggtggaaatctccgaagatttataccgctctttactggtgggtcaatcagaaggcaaacaaataatcacagatgaaaacggttatccgcagttagccgacccgcaacccagtccatttcatcatattgaaaaggggcaatgggttatttcgcctgaaaatcaaaccgcacttttaacccaagtgcgggcggaaatgcgagagaaaatcaatgccttgcgagatgaaaaaatcaatggcggggtgtttgtggaagcggtgggcaagtggattgatacggacgctacggcggagcggaatatcttatccgtcaaagccagttatgatttattcggtgatatggaaattgcatggacttgtgcggataactctgtattgatgattaacaaagaaaaattaatgctgatttggcaagcgttaatgaacgctaaaacaggtaatcatgctaatgccttgaagcataaaaccgccatggagcaatcggacaatccggcggaatatgattattcggacggktggacaaaatgctatcaggattatttaaaggagcagaatgatgagtaaattaaaatattggttttatcatgttttaattgccgttgaccaattactcaatgctgtttttggcggtgcagcagatgaaaccttttcaagccgttgttatcgtggtgcggtrttgrcraarmarcckaaaaaacgttggcgagtgatacataagattgttgaaacgcttttcttttgggaaaagggggagcattgcgaaaatgcgtatctgtcggagttaaagcgtaaacaatatccagaggattttagcagtaaaggttagtcaatctattatggctaaccgtctaaaaataacaaaaccgctttgtattttaatatatgagcggttttgttttgtgtgtcataccgacttttcggcatggcttttttctataacaagaggacaaataatgggcattttaaattcgatgagtgaggggctgcaaaaccccaagcaaaaaccgcttgcacaaggcactgcgaccgcacaatctcaaaacactagccaatcaatgccatcaatggctcagaatgtaacgaacaaccttaacagtaattcgttattaatgaaaagtgcggcacaaaaaggcaatcgaatggcggcacaaagaggattgcaaaattcaaccatagggattgagtctgctcaacgtgcgatgcttgatgcggcgattccgatagctcaacaagatacgcaaaatcagcaacaaataaccgtagcaaacttgaacgctaaactttcacatgataacgcaatgaaagagttgggtgctcaagtgtcggcgaatacaatcggcaaatctattgattatgcaatgcaaattacaaataactttgacgctcaaattgctggtgtgctgaataatacgcaaatgaaagaggaggataagaaaaaagccattgagcaattgaaagcaagtcgagatacggaattgagttttatgagtaggtttatgcaaaaaattccgacgacacaaaaagattgggcggcattcccgtcattgggcgtaccgacaatcacaatgaaaccaacagaaacagggggtaaagtatgagtttttgggattcagcttggagcgtaattacagagtctgccaaatggatggaaaaaaaccaagtggcaacaaatttaatgggaagtgtactacaaggaactgcgggctattttcttcaaaaagagcaagctaaaaatcaaatgcgacaacagagagagttgctgaatttgaaagatgaaatgcaatcaaaatattctgcggtaccggaagtagactcaggttatggtggacttgtggttgatgaggcacctaatttggcgaatggcggtattttaactgaaatgaaaaaannnnnnnnnnnnnnnnnnnnnnnnnnnnnnnnnnnnnnnnnnnnnnnnnnnnnnnnnnnnnnnnnnnnnntcgcgatagagatagagacagaaatacaggtcgcaataatagctatgatacgcaaagtatggataatttagctaaagctattcacgacggctcttatcaaggaaaaaatgatagcagatggtctcgtcgagacaaggacggctatagttcattcggtcgagatagagataatgaaaagtatagtaactatgccagcagttattctaaaggaaaaagtgcgattggaagtgcggtacaaaaccatcgaaatttagtagctaattctccgtccgatctcaaatcaaaaacgctaacgggtgaaaatgttgatgatggtttgttgtcctcaaaccaaaataagcaatatagtccaattgactatgctgaaatgtataaaaacggacctcgtcatccgatagaaaaagcaacgttgggtaagcgagaaatgggaccgatgagccgaattgcacctgaagatccacatgctaacagctatcaaaactacagatatgtacaatccttagcgaataaggattggatagaagatacgcaacgaagcatagccggaaatgcggttggcggaatatcttcctccggagtggctaatgcggttgccggtgctgtagggggcggcttaggcagggctgtagccggagcagtagcgggaatagcagcatctaatgccggagatttggctaatatggcagtaggtaaagccaacaaagaaggattaacagatgaacaaaaagcaatgtacgatcaagctttctcacagagacaggattatttcgacaagagaagacgttcatttgatagtttcggtaatggtatagcgactgttcttggcaccggtgtcgatattgcttcaaaagggctaaccatgggggcaggctctaccatcgctgatgcctacaaaaataattcggcattggagaaaaccttggaaaattttgatagccctgaaaataggcaatttttaaaagaaagacaggaggcgtacaagcgtgcaagggaagaagatgcgaaaagacgcaaagcagatgggtcaaataaaggcattctctacaatatgactaaacgtctacagcctcaagaagagccacaagagccaactttaccttactatgctattccggcattaactaatctttggaataacgtcattgtgaaataaacaacaggagaaaactcaatgggtattttagataatatggcacaacaagccaatgcacaaccgcaaatgcaacaaacggcgacactaccacaaactgaacaaacgggaaatatgatgcaaatgtatcaattcttaatgcaaaactcaatgcaagccatcgcagaaacggcagagcaacgcattcacgaaaaaggaccggtagacggaacggcagatttaattgcaaccgcaatggtttcaaatcttcaagcggcacaacaaaatggtaaaaccatccccccacaagtcatgttacaggtcgccaaagatattgccatgcagttattacaacaaatgggcgtaccggaagagcaacttgatgatgtattgattgacgttttatttaaagcgttggatcaatttggtgaaatgagccatggcatgttatcagcggaagaagagcaacaatatgtcgacatgatcaacaaaatatctgaggcggaacagcaacgccaagcacaaaaaggcgaaaatccgaccgcacttgaacaggcacaaacgggaggtatgtaatgggatttggcggtattttagcctcaattgctcatggattgggcggaggtatgattaaagtcgcggatgagggctggaaaaaagaagcagacgagcgtaaaaatcaattctatgcagatcaaaaagcattagatcgagaggctgaactaattctattagacagaaaacatcaaaatgacattaattttttgcataagaaaaatgcgatttctcaagcggttaacaatagccctaatatgaaagcgatgaatgaaatcaaagacgcttttgatgcaatggacgcaggaaacaaagaaattgcacgacttgatgaattattagcggataaatcactttccaaagagcaacgagaaaaacttacaacgcagagacaggcaatttacgatcatgtttcttcagtagccaacaacgaagaaatttggaaaggaattcataaaggcagatatggtcaagcaatacgcggcaaacatattcaaatgactacaccatacaaaaagacaccatctccagtggctgtttcgcaaaagcaagctaaccagcctataattgtaccaaaacctgacaaagctcagttatacggagaagatattatgaggagataccacaatggagaattactagactagcaaaaactctaaaaacaaaccgctctttggattgaattgaagagcggttagaatttattttgtaagctgtatctttgcaagatgtaatggtagttaatgagatgtgaaaatgtgacataaatgtgtcataaaaggtgaaaaaagatagtaaaaggcgtgttttttataggagggtgttctttgattagctttgtaagtctttgttttaaatgttgtttttgttttatttggtttttattaattgctcttctaagccgtaggtcattggttcgaatccaaatagggcgtgccatttcttaaattcctctaacaaccaaccaactacagctccaatgatctaaactaacgacagcttaaaaaacaagtattttttgctatctcaaaacaaagcattgtatttatatacagtataaattatgatctaaaagaaccgattacagaatttaactgttaccaaaaactgatccaaaaacaaaaaaagtgtaccaaacagcagaattaaaacccaagccatgtttaaaaaaatcacccaagcaaggcacatgaagctacgccgccaaaaagacggtgtagaactagggtttagcggaaataccgcctacatcgccactattcatcaatacggattaagagcaagagtagaacgacacaaagaacacaaagtacaatacgccaagcgtgaattgctcggccttacagagcaggacaaagaaatgattgaagcgtttgtgatcaacgcattgagtgaaaatattgattagatgtcatcatctaaattcttatttttgcagtggcaacaatttttatcacgattggacgtatcataaaacaacacaaagataaaaaataaagcaacactgccaaaaataaacgtcagcccaacgcttaaatcaaaataaaaataacaaataaggtaaggacacgcgacaattaacacaaaaataaggtcaataaaatnnnnnnnnnnnnnnnnnnnnnnnnnnnnnnnnnnnnnnnnnnnnnnnnnnnnnnnnnnnnnnnnnnnnaaatagcaaataaccgcaataagaatgatggcacttatgccccattcaaggctaaattgataatcgacctgttctttagcatgataacgtccggatttcttttgaattgccattagcactgtatccaaaagtaacatcaaaggcgttaatgcaaacgtgaataacacgcaacctataccgacagggatagaaagcaaaaaaacggaagtaagcaaggaactgaaaaaatgaatgacagataaggtttcccaactcatccttagcgaaataccaaacaacacaataacggtaaacatagcactgatgtagtacaaatgagtaacccaaaaaaaagtaaaattttcatactttaattcatcgtgtcgcataaaaacccctgtgttttttgtgtatctttgtttattttttctacgttgtcaatcttatttcaacatattaataatttgttctcgagatcggacccattcataaatcactgacaaaaatagttttggccagcattgccggttgattatcatccatatcagcaaataatgtggcaagtttttgctgtgctgtgtcataatcaccttggcttaatgcgttgatcactggattcaatattgggttcattaattgttgatatttctccggtgtcggttttaatccgtctaacacttcatcaggatctttttgtaccgataataacgctattttccctttgcctatcttttgaaccgacaaaagtgcggtcatatttggcggtgttttacgctcgaatacagcttcgttttctgttacggtacttgcagtttattcgtataaactttgttgatgttcatcaggtctggttttaaatcggcgatgtaaccacatatattgtgttacatcttgcaatatttccttttctacaatcttattcattcgtgttgctattgccgtttcatcatggcgaatatccgaaaaatcaacaggtgctgaaatgttcagcgtatatccagagttatctttgttacgaagcggtgtaaaagggataactttgctcttaggtgatgattttattaagtagtaacttccggttgtcgttgccgcctccggtacagcaaaaaaaggtacgaaaacagcattttttcttccataatcatgatccggagcgtaccaaatcatttcaccatgacgaatagctttaatcattgcacgtaaatctttgcgatccaataaacctttatttgatcttgcacgtccacggcattgtaaccaatccattaaaggattatcatgcggtcgataaatgccaatgcctggatgagatagaccaataatccttgcacctaattctaaagtgagaaaatgaatacctacaagaataataccgtcttgttgattttcttttaaatattcaagcccttcaattttgctccatttttttattcgtttatctgaccaaaaccaagccataccggtttcaataattgccatgcctgttgctttaagattggattgcaatatatcgttgatttcctgttcagaataatgaggaaaacagagctgtaaattttggcgagcgatttttgttctgcgttgaccgattttcaaatgagaaaataaagaacctaaaccgttgccgattttaagtaagattggataggggagcaataaaataagacgaaaaaataaaaaacctaaccagaaaagccagtatttaggcttaagaaattcaatattaaattgtggaattgatgtttttgccataatgttacttagtctaatacaactttgattttgcgttgtagtttaacggaaatttgacgaaatagcatttttactgtggtaaaattagcaaaattttagtgattttatgagagaaaagaaaaatgatgcaatattcagcacagtttaatcaagctaaagtactggtgctcggtgatgtcatgcttgatcgttattggtttggggcaaccaatcgaatttcacctgaagctccggttcctgtggttagagtacaagaaaatgaggaaagagcaggcggtgcggctaatgttgctatgaatattgcctcgttaaatgtacctgttcggttattgggtttaacaggaaaagatgaagcagctagggcattaatgcagctattggaaaaacaaagtattcattgcgactttactcaacttgactcgcacccaactattactaaattacgtatcctatcacgtcatcaacaattattacgtcttgattttgaagaggatttcaacaatataacaagtgcggatttattgtgtaagcttgaaagtgcggtacgaaattatggtgcattaattttatctgattatggcaaagggacattaaatgatgtacaaaaaatgatccaaattgctcgtaaagtaaatattcctgtattgatcgatccgaaaggaactgattttgcacgttatcgcagtgcgacgttattgacgccaaatatgtctgaatttgaagcggttgtcggaaaatgtcatagtgaagaagagattgcagagaaaggcttgcagttaatcaaagagcttgatttatccgctttgctggttactcgttcagaaaaaggcatgaccttattacgtccaaacaatgcaccatttcatttacctacggaagcaaaagaagtgtttgatgttaccggtgcgggcgataccgtaattagtgtattagctaccgcacttgctgacgggcgtagttatgaggaggcttgttatttagcgaatgtggcggcagggattgttgttggcaaattgggtacatcaacagtttcaacagttgagttagaaaatgccattcatggcagaactacggcaggttttggcattatggaagaaagtcaattaaaagcggcggtggaattggcaaaagcacgaggagaaaaaatagtgatgacaaacggttgctttgatattttacatccgggacatgtgtcttatttagaaaatgcacgtaaattaggtgatcgtttaattgtcgctgttaatacagacaattctgtaaaacgtcttaaaggtgaaactcgtccgattaatgatttggcgactagaatggctgttttggcgggattatcttctgtggattggcttgttgcgtttgatgaagatacacctcaacgtttaattgcagaaatattacctgatttattagtcaaaggtggagattacaagcctgaggaaatcgttggcagcaaagaagtctggctaaatggtggcgaggtcaaggtgttaaattttgaaaatggctgttctacaacgaatgtgattaaaaaaattcaacagttaaaagagtaagggaacattatgattacggtatatggtattaaaaattgcgatactgttaaaaaagcattgaaatggttagcagataacaatattgaataccaacttcacgattttcgtgtagacggtttacaacaatattggctagaacaagcggaacaacaatttggctgggaaaatttagtcaacaaacgtagtacgacatggcgtaatttagatgaagaaatcaaacaaaatctgactaaacagaccgcacttaaaaccttacttgcacaacctactttagtaaaacgtccgattattttacaagatggcaaagcgttgattgggtttagtgtagaagattatgaacgtgtattgaaataaaagatcaacaacgttctatttaacgtatggcatattgcaatagtgcaaaatgaaactatgaattgataaaaggacagatgctacgcaaacgttcgtaaaaaaataaaatcttatgaaaaataacataattactctcactcaaagtcttattcaacgtccttcaattagccctgatgatcaaggctgtcaacaacttattgccgaacgtttacaagctgttggttttaagttggagtggttaccttttggtgataccttaaatttatgggctactcatggtgaaggaaaatgtattgcttttgcggggcatacagacgttgttccgattggtaatgaaagtcaatggacttatccgccttttgaagcccgaattgttgaaaatatgctgtatgggcgtggtgctgcggatatgaagggtgctttggcagcaatggttattgcggcggaaacttttgtgaaacacctgccaaatcatcagggaaaaatagccttgttgattacctctgatgaagaggcagcggctaccaatggaacggtaaaagtagtggaaacgctaataaaacgtaacgaaaagattgactattgtgtagtaggtgaaccttccagtgcaacgcaatttggcgacattatcaaaaacggacgacgtggttctattacaggaaatttgtatattcaaggtgtacaaggtcatgtggcttatcctcatttagcggataatcctgttcataatgccttgaaattcttagatgaattaactcattatcaatgggataaaggtaatgaatttttcccgccgaccagtttacaaatcgccaatattcatgcagggacaggtagtaataatgtaatccccggtgaactttatgtgcaatttaacttgcgttattgtactgaggtgacagatgaaattattaaaactagagtggctgagatgttggaaaagcataagttaacgtaccgtatagactggaatttatcgggcaaaccgtttttaacacctcaaggaaaattagtaaatgccacaattgaagcagtgaaaaaatttactcaaatcagaccgcacttagatacaggcggtgggacttccgatgctcgttttattgccacaatgggagcggaagttgtagagtttggacctctcaatcaaactattcataaagtgaatgagtgtgtgaatattgatgatttagccaagtgcggtgagatttattatcatattttggaaaaattgtttaatgaacaataagttatcaaaaatcctcacaggaaaaagtcgtgaacatttaatttcattaccgaatacgctttcggctaatcattttttgcagatggaagttgtcggtgcttttttgcagttacagcaagctgcaaagcaagctggctttaatttacagccagtaagtagttttcgtgattttgaacgtcagcgttcaatttggaatacaaaattttatggagaacgtaaagttcatgatgatcaaggaaagccgctagatttgaccgcacttgacgattggcaaaaagcacaagcgattttgcgttggtctgctatacctggagcaagtcgccatcattggggaacggaaatcgatatttttgatcctgatttattgccaaaaggacaatctttacaacttgagccttgggaatatgaaacaggggggtattttcaacgtttaactaattggctattagttaatgcacaacaatttggtttttattttccgttttttgagttaaaagataaaaaagtgggcaatgaactttggcatttaagctattttcccattgcagatatatatcaacaacaattttgccctgagtttttatcacaagcgtggtacgaggaaaacgttgcgggtagcgagatattattgaatcatcttgatgaaatatttagggattttttgatttaatgatttaagctatttttagccaatccaatttttcataattttagaggtatatatggaagttcagcaatttactcagcaagatattgaaattcttcatgaagaaacattgtacaaaggtttttttcaattaaaacgcattcaatttaagcataaactgtttgctggtggtgtgagtggagttgtaactcgtgaattactttataagggggcagcatcagcagttattgcgtatgatccatatttagataaggtgattttagtcgaacaagttcgcattggtgcttacgatcccaaattaaccacatcaccttggttatttgaattaattgcaggtatggtggaagagggagaaaaacctgaagaggttgcactaagagaaagtcaagaagaagcaggcgttcaagtagataatttgcaacatgttttaagcgtgtgggatagtccgggtggagtgattgagcgaatccatctgtttgccggaaaagtggatagtacaaaagcgaaaggtattcatggcttggcggaagaaaatgaagatattcaggtgcatgttattagcagagaaattgcctatcaatgggtctgcgagggaaaaattgataatggtatagcggtcatgggattgcaatggttacaactcaattataaaactttgcaacaacaatggttataaaatgtgatacagattatattttttataaaaaattagataaaaatatgatcctgttaacattttcattatttttttaatgcaattttttattaaaacagtaagttataacccgtttgttgtatataaagggtgaatattttgatcagtacatatcaataccctacttcagagaaagtagttcgtttaattcagattaccgatccccatttatttaaagaaaaaaatggagaattacttggcattaatacgtatgatagttttaatcaagtattaagcgaggttttacaaagtaaatttgattatgagcttgttttagcaacgggagatttagtacaagatagcagtgaagaaggttatcaatattttgctgaatcggttaattcgttgaataaaaaagttttttgggttccgggaaatcatgattttcaacctaaaatgtttgatgttttaagtcaatatcaagaatatatttatccgacaaaacatgtattagtgggaaaaaattggcaaattttgatgttggatagtcaagtatcaggcgtacctcatgggtatctaggacaatatcaattggattggttgtcagcaaaactgagagattatccaaaacgccatgccttagttgttctacatcatcatattgtttccactaattcggcttggttggatcaacataatttacgcaattccttagacttaatgcaagtattgttaccttttagaaaagtgcggggtattttatatgggcatattcatcaagcaatggatacaaaatggcagggatataaaattatggcaacgccttctacatgtattcaatttaaacctgacagtaatcatttttctttagacacatcacaaccgggttggcgtgaaattgagttatatgatgatggacgaattgaaacaagagtcaagcggattcaacagaccagttttctaccgaatatgttgagtgagggctattgatgaaaagcgaaaagtgcggtgaaatttttgattttttcaccgcactttgttgttcaagtcatcataaataacattcgctagaatttcatttctaatgataaagcaaaattacgtccagcagcagtaaagcgttctaacccttttccgttgttatatacgtcgcccaatgcaccattctctttgatttgtcgtaatgtatcccaagtggtgtacttacgattgaataaattaaagatgcctgcatttaaggtaaaatgggaattgaggcgatattgtgcggttaaatcaaatacgacataagaactgcttaaaaaacgataaggtttgggttgcctaaagtcggatacaacacctgtttttttatcaacatccaattgcaagctatttatattcggaatatcaatagcatctttggcttttttagcactgacatatcgcccgctgaagagaacattccatttgtcgttctccgcttggtagcctaatcccaacgtcgtgctaaaaggctggattggtaacatcgccgtgccattatttttacgtccttttgcatagcttgcttttaatatagcgtaccaagatttggataaaccaattattttcccgttagcacgggcatggaaatcaagaccggtaacataggctttatcaatatttatctgctgataatttacgccatctaaataatattcagtatatttttttcttggcttggttgcccagtcaattttttgacgagatccgactttcggttttgtttcgacatcaataaaatcccgatattttgtataaaatacagccaagcttaattggtagttgtcgccttccgtggtaagagagagttcatgattttgtgctttttcaggttttaaattgatattaggtaaatattggacatcacttgccccttttaaatcaaaatacatttcttctattttcggtgctttaaaacctgtgctgaattcatagctaagtaacgtggaatcggtgagcgaataatttaatcccaacgaaaaattgaccgcactaaattgtttcttgggtaaaacttcgactttttgactggcaagatcatattttaatgcacttgtggtgggcttatagcgatagtgatcgaagcgtattcctgcatttgctccccatttttgattaatactgattaaatcctgcacataggcataccaagcctgacgggcaacaggttgctgaatagtgaattcacgttgttttatccttgaataagcaccatactcttgatttctattttctaatttaccccaatgataacccaatcctcctgataattgatgatgagcaaacttgccggcaatttcattggcaataaaagaaacatctaattgataatgcttctgttctgttttatataaacgcttgtcagtaataatattataatcttgcggagaaacaccatattgattggaattagcctgttgtgagactttttgttgggctaattgtaggctaaatttatttagccagctttccgttggggtataattataggaaataccaagtcgctgataaggtgttatatcgcccgcttcttgacgatttgaagcataaaaacttttttctaaaatttttctgctttgctcaagattttcaaaaaaaccttgcacaaaatgttgtggagtaaaatgatatcctaattttgccaaccaagatcggctgtgataatccacattatcaggtaatacacgactacgcccacataattggggaaagatatctcgctggtctccatttggtaaaatgccacaatacgcaacgtcttttagtttgccactgtagtaatttttgttttcatgtgcatggcgataggtgtattgcaacaatccctcggcgttaccctgcttgaacccccccctatcacttggcgatattccgtattacgtgagctataggcagttttagcataaaatccaacagttttattcgagtctacaaaatcatgcacattttttgttcgcatcgacacgctaccgcctaacgcaccgctaccttgtgttaaagaattcgcccctttattaaattctacactacttaagttttcaatttccgtgctgttgcgattaccattataaaatcctttaatatagtaaaagcgaggcatataactttcgaccgcacttattccatcaacactcatcgccacacggtcgctttctacaccacgcatagtataaccattggcaccgccacgccctccttcagtgactgtaacacctgtttgccaacggaccaaatcctgttcgttccataccaaacctcgactaatttgttggctatttgtgcttgaagttttagccgatacttgttgcgtttcaacaacaatctgatctaatgtagcagaatcattaaattgagcgattgtactaaatgaaattagaggcaatgtaacagcagaaaaccgcagtaacgtttgctgacgatttttatcaaaaaacataatatccctcttgaaaataagaatcaatcttattaatgataacagagatattactatatcgctattccttcttttatttatctaattggagaaatagaaacctttaaaatagcagaaatataaaattagacctttttcttactaatggtatctatccatactgctagtaataaaatgccaccttttacaatatattgccaaaaagtcggtacatccagcatactcataccattatctaataatgcaatgataaaagccccgattactacaccaaaaatactgccgataccgccggctaaactggctccaccgataacacaagcggcaatagcatcgagttctgcattttgaccggcagagggtgctccggctcctaaacgggaacttaaaatcaagccggctattgccactaataagccgttaagagcaaaaatggttaatttaactttttccacggcaatacctgataggcgagctgcatcaatattgccaccaattgcgtaaatatgtcgaccaaatgctgtttttttcgaaatgaatgttcctataatggctaatccacagagaattaatactggaattggcatgcctcgataatcgttaagcagataaattgcaccaagaataaggattgctatcatgccatatttcactgtttctttgggcattttggcaactggtaaatttaggttttgtctggctttacgctgataacttccccaagcaataaagcaaaatattatgatgctccctaaaattatccctatggtgtcggaaagataaccttgaccgataattgtcatatcattactgataggggaaacggtagtaccattcgttaatccgatcaaaattccccgaaatgcaagcattcctgctaaggtaacgatgaaagatggtactttttgataagcaacccaccaaccgctccacgccccgattagtaaacctaagagcaaggtaacaaggatagttaagggtaacggccaaccccaccaaacattactaattgccgcaaagccaccgagtagccccattagtgaaccaactgataagtcaatttctgcagagataatcacaaacaccataccaatagcaagaataccagtgatagcagtttgacgtaataagttagagatatttcttgcacttaaataagccccttctgttgcaattgagaaaaaaaacataatcaccataatggcaatcagcataatatagacttgtaaattgattgatttgaacttattcatagcttactccttaagtgcggcttccattacttgttcttgagtgagatgatggttgattaaatccgctttaactttaccttggtgcattactaatacacgatcgcttattcctaaaacctcaggtagctctgaggaaattacaataattgacattccttcctgagctagttggttgattaatttatagatttcatattttgcaccgacatcaatacctcgagtcggttcatctaaaatcaaaatgttaggatgtaataatagacattttgctaaaattgctttttgctgattacctccacttagccggcctattgcgagttcaggcgaggaagttttcactttcagtttggcaatagattgattgataatggtttcttccagcggttcgttaatgacttttttaccaaagcagaattgagacaaagaagataaggtaatatttttacctacgctcataataggaataataccgtgttttttacgatcttccggtaccatgacaatatgatttgcgatagcttctgcgcacttgttgattttaactttttggttattgagaaaaatgttaccttggtattttcctacataagaaccaaaaatacattgagccatttcagttcgccctgaaccgactaatcctgcaacaccaagaatttctcctttccgtaatatgaaattggcattatcaacgcgtttaatatgtgtattggttgggtgccacgcagttaaattttctacgcgtaaaatttctttgccaatatcgtgtggctcgtgtggatacaatgaggtaatttcacgtcctaccatcatggtaatgatgtcatcttcgcttatcccttgtgctaattgagtgccgatgtgttcaccgtctcgaattacacagatcttatcggaaattgcttttacttcatttaatttatgagaaatatagatacatgcgatattgtgagcttgtagacctttaatcagattaagtagaatgtctgtttctttttcggttaatgaggcggtcggttcatctaaaatcaataaacgaacttgtttattcaaggctttagcaatttcaactaattgttgttgccctaatcccaatgtactcactttggtatttggatcaatatcgagctgaacctgctctaataaggttttacaacgcagatacattttgttgtcattagtaatacctgcttgggtaatttcattccctaaaaacatattttccaatactgacatatttttcactaaagtcagttcttggtgaataatcgaaattcctttttcttccgtatctttaatatttttagcggttaatttttcaccggaaaaataaatttctccctcataatcccctgagggataaataccacataatactttcattaaggttgatttacctgagccattttcaccacatagagagagtatttcgccggtttcaagggaaattgaaatattatttaatgctacaacatcaccaaattttttagtgatattcttcatctctaataatttcgtcataacttcacccctttttttagtatggcaagacataaaatcttgccacataaaatattttattatttataaacagcctctttggtatggaaaccatctttaatcaccgtgtcatcaatattctcttttgtaacgacgacaggctctaataggaatgcagggacatttttcaatccgttatttaattgagagttggattccacttttccacctttacctaacgcgactgaaatttcggctgctttatctgctaaattagtgattggtttgtatacggtcattgtttgtgaaccgtcaagaatgcgtttgattgccgctaaatcagcatcttgacctgaaatcgctactttgcctgataagccttgagcacttaatgcttgaattgcaccaccggcagttgcatcgttagaagcgactaccgcatcaatattgtttttgtttgcagttaacgcattttccataatttgtaatgctttttcagctagccaagaatcaacccattgatcgcctaccacgttgatttcgccactgtcaatgtgcggttgtaatactttcatttgacctttacgaaataattttgcgttattatcaacaggtgaaccgcccattaagaaataattccctttcggttttttctcaataatgctttgtgcttgtagttcacctactttttcattatcgaacgaaacatagaaatcaatatctgcgttattgatcagacggtcataagctaaaactttaaccccctcttttttggcttcagcgatcacgtttgacaatacttcgccattgaatggaataatcactagcacatcaatatctttatttagcatattctcaatttgagaaatttgagctgtcgcatcaccatttgcagattgaacgaatacttttgcacctaaagcttctgcttttttcacaaaaatatctcggtctttttgccatctttctaaacgtaaatcatcaattgacatgccgattttcagatcgtttgctagcactgaatggctaaaaaccattaaaattgctgtcgcgaccgctaataacttagatttaagtttcataaaatacctcacttggttgagagaatgatgtaagggtataatgtagttgccccgagtgaagtctgcggagatttggtaataagtgcaattatcagatttattaatgtaattatgttttttcgcttttgtgatctgttcgacattaaccaataatctaaatccaaaaacgaaatatcgtaattgagggttgttttcaattttaagatgatgagccttgtattcatatttatcacatctcagaggagacttggctatgtctaattattttgacaaaattgcaaaggtaaattacgaaggagcaaattccactaatcctttcgcttttaaacactacaatccaaatgaagttattttaggtaaaacagtagaggaacacttgcgtctggcagtctgctattggcacacgttctgctggacaggtaacgatatgttcggtgccggttcattggatcgtagttggcaaaaaacaggtgatttgctggttggtgcaaaacaaaaagcagaaattgcttttgaatttttccaaaaattaggtgtgccttattatagttttcacgatgtagatattgctcctgaaagcaataatttcaaagaatatttacataacttcaatactattgtggatattttagagaaaaaacaatcagaaaccggtgtgaagttgttatggggaacagcaaactgctttactaatcctcgttatatgtcaggggcttctaccaaccctaatccggaagtatttgcttgggcagcagcacaagtttttactgcaatgaatgcaactcaacgcttagggggtgaaaactatgtattatggggcggacgagaagggtatgaaacattgctgaataccgatctcaaacgtgaacgtgaacaaattggccgttttatgcaattagtggtagaacataaatataaaatcggctttcaaggtacattactaattgaaccgaaaccacaagagccaactaaacatcagtacgattatgatgttgcaacagtttatggttttttaaaacaattcggattagaaaatgaaattaaagtgaatattgaagctaaccatgcaaccttggcagggcatacattccaacatgaaattgcaacggcaacttcattaggcattttcggttctattgatgctaaccgtggcgatccgcaattaggctgggataccgaccaattcccgaacagcgtggaagaaaatacgttggcaatgtatgaaatcttaaaagcgggtggtttcaccacaggcggtttcaactttgatgcgaaaattcgtcgccaaagtaccgacccgtatgatttatttcatgcccatatcggtgcaatggatgtgttagctttgtcgctcaaacgtgctgcaaaaatgattgaagaccaaacgttgcaaaaagtggtcgataaccgctatgctggttgggatcaagagctgggtcagaaaattctaagtggcaaagcgagcttggaggatcttgctaaaatagtagaaactcaagggttagatccaaaacctgtttcagggcagcaagaatatttagaaaatttagtgaatagctatctttatcgttaattctgacaagcggtctttttttgcaaaattttgcataaaatgaccgctctttagattaaggagtatttatgtacattggaattgatcttggtacttctggggttaaagttgttttacttgatgaaaatcaaaaaattattgccattactcaaaaatctcttcctatttctcgccctcaacccttatggtctgaacaaaatccacaagattggtggaatgccactcacgaagcaatgcttgaattagctgataagcaaaatttaagccatgtaaaagctattggattaactgggcaaatgcacggtgctacattactggataaggcagataacatactttctccggcaattttatggaacgatggacggagctttgctgaatgcgaagagttggaaaaattagtgtcaaatagtcgtgaaattacaggtaatttaatgatgccgggctttactgcacctaaattatgttggcttaaaaaacatcagcccgatattgccaaaaaagttagtaaagttttgttaccaaaagattatttacgatttttaatgacgggagaatacgcttctgatatgtctgatgcctcaggcacaatgtggctggacataggtaaacggagttggaatgaagcacttttgaatgcttgtggacttgatttgaataatatgccgaaattatttgaaggtaatcaaatcacaggttatttacgcaaagaaattgcacaacaatggaaaataaatgccgtacctgttgtggcaggtggcggtgataatgcagccggtgccattggtataggactttaccaagcagagcaagcaatgttgtctcttggtacttcgggtgtgtactttgtggtaagtgatacattccgtgccaatccacaaaaagcagttcatagtttttgccacgcactgcccgatcgctggcacttaatgtcggtgatgttaagtgcagcctcggctgttgattgggctgcaaaatccctaggctttaaagatgtaccaaccttatttcaacgagttgaagcaagccaaaccgagtccaatgtcattttcctgccttatttatcaggcgaacgtacaccgcataatgatccttatgcgaaaggtgtattttggggattaagccatagcgataatcaagttacgatggcaaaagccgtcatcgaaggcgtgagttttgctatggcagagagtattgatgttttacatgaaacaggtgttactgcaaataatattgcgcttattggtggtggagcaaaaagtgcttattggcgacaattacttgctgatattagcggtaaaacatttgaatatcgtacaggtggagatgttggtccggcgttaggtgcggctaaattagcacaaattgcattaaatccagaacaagatattgcgaatttctgccgaccattaccattggaaaaaatctatcagcccaattctgctcgctatgcagaatatcaagctaaacgtgagaaattcgcagagctttatcaacgagtaaaaggtctatcgttgttttctttgtaactcaaagatatataagacttttcctgatctaaaagtgcggtgagaataccgcacttttaggggtatattttagatacaaaaaaacggcgataacaacactgctatcgccggtttagttttatatgatgaattagttaaacacgccgctgaygccgacacggaaacctaytcgrccwcgrctrtcrgargamatrccgccggakayrgcmyatttwccrtttgcggaagttctaccgaggtttaaagagaccgcactttcgctgctataacgagcggcaccggcggcgtaagaccattttcccrggacgaaagggacttctttgaaagccatagcggcggcgataccggcttttgcgtctttgttgacttcttcaagacgttggttrgtggcntgaagctgactaccnttgaccgcatcrgtkgattgatgagaaagcaaaccggcrgcaacattttgaatacgrcgttcattgcctttgytkcccacggaaacgacrcctttmgcrtcwacgccagcgtaattgccstcgactttacctataccgccggtagtatcgcctttttctacataagcggaactattgcctaggaagacggagttatcagtggtaacatcaatatcatttcctatggcgacggttttggtgccgttattcgtaatattacgacctattgagaacgaattatctccagtcgtatgtacattactaccaaaacttattgagccctggcctgaggcttttgcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcctcatcacctactgctactgcaaactttccagttcctttagaatctttacctatagaaatcgcctgtacacctgcatttgcttggaagcccattgctacggcataagattgtgcctctgctgtcttaccaaccgcagttgctccttcatgtgctgcatttgcttcaaatcctacagcgacaccggactcagctactttggcattttttccaacggcaacggatttggtaccatccttatacattccttctgccttagcaccttcaccaatataaacatgcccattactaacatcaatattactactatttgattgttgagcttgagccatagccgaatgagcagttaaaacaactactgcagttaaagataaataaaaaattttcacttaaaagaaatccttaaaaaaagagttaacatagaaaaatcataaaaaagctaaccgcactaagaggcgataatttatgacacgccttaaaaagaggtagggggacctaccaaagcgggcgaaattttaagcggggggggggtactgtcaatatatttttttacaaaatgtttacttttttaacaaaattgaaacggtaaaaaacatttgtcgaacacggaaaaatattcatttgtttttgtgttatggaatgcagtagaaagaagaaatgaacttgcgtaagtgatttaaacgctccacgcattttcatctagtacttgtccaaaatgactttcaacgaggcgtttggttatatcgctttgtggttgggtaaagattgtttttgtatcgccatattcgatcatttgtccttcgtccatcactaatacatgatcggctatgtgtttgatgatgcctaaatgttgacctacataaatataagagatgctgagtttctcttgaatgtctaacatcaaatttattaattgagttttgactgtcgcatcaagtgagccgagagcatcatcggtaataataatttccggtccaagaataagtgcacgtgcaatagcaacacgttgtttttgaccgatggacatggtattaatttttacattggcatgttcgggataaagtcccactaaacgtaatgtttcagctattttaagattacgttcattttcgtttaggttggttgtcaggcgtagaggtgcatctaaaatttgtcctacatttaaacgaggattaaaggcagaataggggtcttgaaagaccatacgaatatgttgtgaacgatattgataatctccgtactctaagggatttcctttaaatagaagttcaccagatgtgggttttataataccaacgatcattttggcaacagttgattttccagagccatttttaccgataatagccaatgttttttttcgtgccaaaacgaaactaatattttctacagctttaaattggcttgtgctgaagataccaatattatcattaaaaaattttgataaacctgaaacttccagtaagttcatttttacttcccgttcttattttgttgtgtttacgactaatggaccagtttccatttctttttctctacgttgactttcttttaaattaatagggaaatggcagaaaaattcatgttgtttaatccgttgtgcacttggttttcgaatacattctttttgtgcaaaaggacaacgtggacctaaacggcaaccgataggcattccttctaataatggaacagcaccttttagcgtactcaaacgacttttatgtactaagggctgtttaaaatcaggaatagaatgtaataatgctcttgtatagggatggtgaggattttctaaaatgttttctttagatcctgattcagcgttttgtccgcaataaagaactgaaaaactatcacaccatgcactaatactatttatatcattacttaccagcagaatacttgttccctgattttgattcatactggcaagtaaacgaaatatttgtacttttgtcattgactcaagagaatttgtaggttcatcagcgattaataatcgaggttggtttgcaattgcaagggcaatcataattttttgtccttcaccttcagttacttcatgtgggtaactttgcataatatctttatgatctttcacacctacacgatgtaataattcaatagcacgacgttttttccaaccgaaccattgccaccatcgccctttaaatgtccaagagggaatgctctgaataagttgttgtccaatttttcggctaggatctaaagatgctaaaggctcttggtaaatcatggagatttctttacctaccagtttacgtctttttttgggatttagttttagtagttctacatcgtcaaaacgaaaacgatcggctgtaataatccaagaatccttaattgcattacaaataactttagcaatcaggctttttccggaacctgattcaccgactaaaccacagatttcaccttcatttaaggttaaattaacattatcaataattttgactcgtccttttggtgtttctatttcaatacaaagattacgaatatcaagtaaagccatgttggttgtccttatccataatatttttctatggctttacaaagcccattagtcaaaatgagaacgataacaatggtgatgataatagcaacaccgggtaagattgttgcccaaggggcaagataaattaattctatataatcttttatcattgttccccattctggcgttggtcgttgtgcacccaacgaaataaaacttaatgcactaatatcaataatggcaatgataaatgctctgctggtttcatgaatataacgaataataatattaggtaaaatggtttcttttacaagttgccaattacttgcaccatcaagtcgtagcatcaaaatgtattcttttttcagttcttgttgtacggcttggtaaatttcatgaataaaatagggaagtaatgcaagcgtgatggcaagcattgcattgattaagcttggttgcattaatgtagcgataataatagcgatgagtaaaatagggattgataagaaaatatcaaaaaaatgtcctaagactcttgcttttaacccttgtgataatcctgcccaaataccaagaattccacccaaaatagatgtgaataatacaacaatgagggcggcaccaaaagtgtaagttgtacctcgaatcaaacgactaaaaatatctcgtccaatatcatcagttccgaaaaaataggcaatttttccgttatcagcccaagagggaggtagtaactcaaaaccaataaactgtgctgtatcactataaggtgcgataaattgactgaaaagtgcggtaataatgagtaataaaaaaagataaaagccagttaatgccaatttatcttggtagaaaaatttccaaatatgttttaatccttgtgtttcgcgaaattcttcaggttctttatctagcataccagttcttcttattaaatgggtccaaaataaaggataagaattcagtaaataaattcactgcaataatacaaagcccaacaacaataatgcctattgaaatgctattatagtcttgttgtttaaccgaatctattaaccaatgacctataccgaaccaaccgaacgtgctttcaatcagcatacattgagccataacaagagtaaataaacgactcatttgcgggatcatgataggtattgtgttacgtaaaatgtagatttgtagaatttttctttttgaccaccctcttgtttctgcaattttgacataactttgggtgaataaaaaatcagctcgttgctgaacgattctaataatatccatagttggcagaattgcgagaactaatgtgggcaacacaagatgttgcaaaacattttgaatcattttaatacgataaggctgatccgtaaaccaaacatcaataataggaaagcctgtaatgggctttatctcatacaataaattatactgtccaattgctgaaatttcccaattttgaatagctgaaaagtacaacaagattggtgctaaccaaaaaacagggatagcaatacctgtgatatagaaagaacgaatagctttgccaaacaaattatctgcatataatgcactgagtaatccaagaggaataccgaaaattaatgctaacagcattgcactaacacatagctctaatgtaggaggaagtacagcaaaaatcaattcttttagtgattctccgccgtggtaagtaataccaaaatccccttgtagtaaattttgtagatagaaaaaataccctgaaaaaaagtgcggtgttgctagcacttgatttaatggatctttgagcagaatgctgtaactgatgagagataaaataaacagcgtgctgataactaaaatgcagtgacgaaaaaaggaaaatagcattgttttattacctgtttataatttctattattttttaaatgacagttttgaaaaattaatattgccaaacggcgttaattcaattccctgtacttttgcattcgctaacagaacacgttttacgttagcaataggaagaatagggatttcggataaaataatttcttgtgcgatattataatattttgcacgttcacgtaagttcgatgcggctaatgcttgatctaaggcgtgttcaaaaggtgcatggcaccaatttgaaaaattagttatttcgttttgtgtaccgcaacttaaaatgggacgcataaaactatcagggtctagatttcctgctaaccagccagttaagataatatcgtaatcctcagtttgttcttgaagctgtttcattaaataagtgcgggtaacgttacgtatatttacattcaccccaaccttaattaaatctgctttaattaattcagccatttttattggcgaagggttatacacttgttcttcattaataacccacatatctagatttatattttttcctgcaaagtattcctttgcttttttgacattatagtcataggcaaaatcagttgtatttacaactgccccccaagatattgatggaataatattgttcgcaacacttgctgtattatgataaatcaggttaataatacgttggcggttaattgcatgagcaatatggcgacgaatctccagatcttgcataagtgttttttgaaagttaaatgcgatataagataaattcatgccttcaattgattttatataatatttttcatcattgtgacgcaataaccctaattggctcagttctggataagaggcgatatggcattcattattgaagaatttaattaatctgcctgagcgattagtggaaagatcaatgatcacgttttccaggtttacatttttttgccaataattagggttatgaacaagacgaacatattgattacgaaagtaatctttaacctgataaggacctgtgccgacaggtaaattatctaattgcactaaattgtcgtccgcattgagttgcaatgcgtattcttgagaaaaaataatggcgtattggctggctaggtgggaaagcacggaagcatcgggtttaaacaagataatttgaacttggtaaggattgattgctttcacttcctgaattttttcatttaatttaatgctgtcaaaataaggaaaatgcacttttttacgttgttcgtgatagaccttatattgtggatttttatagtgaagagtgttttgatctaattccggtagtgcgatattctgaccgagtatgcgatttaatgaaaaaaccacatcttccgcattaaaatcacggcttggtgtaaaccagtctgtatgatgaaatttaacgcctttgcgtaaattaattgtaataattttcccatcaggtgagatactataggatttggccaaaactggttcaagagttgcactatgatttttaatttcaaataatttattgtaaatttgctccgtgactatattcatactggttccggcatctgcagtttgaggattaaaggaaaaactgcttgcattggtacaataaatcaaaccgttgtcagtgagtattttgggtatttttggggcactaaaagagggcaaactaaagagtagcccatagaagagtgtacataatataaaaatcttttttgccaacataacttaattaattatgataaattatatgggaattgtaaggcatattaacgcaatatagaaataaaaatgtttaattttatccataaagaacttgatgaactcattaatcgtggaatggaccgcactttacgtattgccgttacagggctgagtcgtagcggtaaaactgcttttattacaagttttattaatcagctattacatattaattccattgacaataaacatcttccgctatttttacctgcacaaaataaccgtcttcttggtgtaaaacgtgttgaacaacgagatctcagtgttcctcgttttgactatgaacaaaatatgaaagcgttgaagcgtgagcctgcaagttggtttaaatcaacggagagtgtcagtgaaacacgtttagccattcgttatatacgtaaagatggcttaatgcgacatttaaaagaaaaaggcacattatatgtagaaatttttgattatccgggtgaatggttactggatctgcccttactggatttggattttcaacaatggtctttacagcaacaagagttatttattgagcaacgacaagaattagcacaaaactggctgaataagatccgcactttagatttaagtgagccggcaaatgaagagatgttggcacaacttgcccaagactatactgaattcttatttgcttgtaaaaaacagggatttcatttaacacaaccgggacgctttgtgctacccggtgaattaaaaggcgctccggtattacaattttttcctctggttcatttaactgagcaagagtggaaaagactaaaagagcggtctaaatctgacagttattttgcgatgttgagcaagcgttatcattattatcaacaaaaaatagtgaaaggtttttatcaagaatatttttctacttttgatcgtcaggtgattttagcggattgcttaacaccacttaatcatggtcgccaagcgtttcaggatatgcaaaatgctttacagcaactattcaaaaatttccattatggcaagcgaactttattcaatcgtttgttttcgccaaaaattgataaattaatgtttattgcgaccaaagcggatcacattacattggagcaatttccgaatttagtgagtttaatgcgtcaattagtacaagagggagggcgttacgtagaatatgaaggaatagatactgaatatactgcaatttccgccattcgttctactcaacaagtacaagtaacgcaaaatggacaaaagatcaaagcattacaaggaattagatcaatagataagaaaaaaattgttgtatatccaggaagtgtaccgagtaaattgcctcatgcagacttttggcagaagtatcattttgcgtttgatcaattcgaacctcttacagtggaaaatggtgagccaatcgcccatttacgtatggatgctgtcttacaatttttattagcagacaagttagattaggatataaatatgcaaaaaaaggtttttcaacaagaagatgttgagcaaaaaatcacagaaaattttgagcctaaacaagaatttgagcaagacgaattagatatagaaatggactgctctcaatctgaaacaacaatggatcggcaaaatacagatattcattttcagcatatggttagaccaaaagtgacaatgtggcaaaaattgctcatggctacgatctgtttgtttagctgtggcattttggctcaatcggtgcaatggttggttgatagttggcgggataatcaatggattgcttttgtttttgctatggtcagtttatttttggttttgttagggcttggagcaataataaaagaatggcgacgtttagttcaactaaaaaagcgtttgatattacaagaaaaaagccgagaaattcgctcaaaaagtgcggttaatttaactgaggtttcttctgagggcaaagagttgtgtttaaaaattgcctcgcttatgggaattgatgataaatcgccacaactcattgcttggcaagaacaagttcatgaagcttacactgaacaagaaattctgcgtttatttagtcaaaatgtactaataccttttgatcgggtagcgaagaaacttattagcaaaaatgccgttgaaagtgcattgattgtggcagttagccctttagccattgtggacatgttctttatcgcttggcgtaatattcgtttgattaatcaattagcaaaactttatggtattgagttgggctatgttagtcgtctccgtttgttacgtatggtttttgttaatatggcatttgccggtgcggcagacgtcattcaagatctcggtttagaatggttatctcaagatataacagcaaaattatccgcacgagttgctcaagggattggcgtgggcatacttactgcacgcttaggtattaaagcgatggaattttgtcgccctatagccgttgctccagaggagaaattgcgtttaagtcatatccaaacagaattattgggaacattaaagacgactttatttagtgccaataaagtgaaagagaaagtgcggtagaaataatttattagtttcaaaaagcaaagattatatacataaaatctgcactttaataagtctgttaaactgttagagtgcagattaaaatgaccaatttttactcttaagcgacaacattaaattgtgctttcatcaatgcttcgaaatctgtgcaaccgccaataggtttttcatcaatgaaaatttgcggcacagtttctactggtttaccgacagacaatgatagatccgctttactaataccttcagcaacaatatcaatataacgataatcgaagtcttcaagggtattttttaatttttctgccaagttttttgcacgaacacaatacgggcaacctgaacgaccaaaaataacaacgtacatatttattttcctttttgtcttgttaataaaagaacgaccacattgtaactcatttggggcaaaaattttagcattgttacaacgaaaaaaacctatttctatcaatatcagaaattatccctaactatcaataagttcaatagtcacaccattatgtaatcctctcggcagaggtgatcctttgcgtcctcgctcagcacgaaatttttgtatatcctccggttttaaggtgacttttcgttttccagcatgaaagacaagactggttttttcgctgatcaagaataatttgaccaataattctgaccgctctttagcatttgcagcgggaatatgaatgattttgttgcctttacctttggataattcaggtaagtcggcaacaggaaaaaccagcattctattcatggaagttaaagcgaccaaaagtgcggtagaattttgcaaaactaatggaggtagtacgttggcattttccggtagggaaataaccgcttttcctgccttattgcgagataccaaatcttcaaatttacaaataaatccatatcctgcatcagatgccataagcaaagattgattttcgttttctatcagtaaatgttcaatagtagcaccgctaggtaaggtcaattttcctgtaagcggttctccctgtgatcgggcagaaggtaaggaaagcggatctaaagtgtagctacgtcctgtgctatcaataaagaccaccggctgattgcttttaccgcaggcatgggtcaaatagttatcaccggtcttgtagctcaaagcccgtgcattaatatcatgtccctttgcacaacgtacccaacccatttccgataagataattgtaatcggttcgctcggtgtcatatctgtttcagaaattgcttttgcctcagcacgttctactaaaggcgataggcgagggcttgcgaaagttttcgcatcttgctgaatttcttttttaattaaattatttaagcgaatttcagagtttaatatttgctctaaactgttccgttcttttgctaaattatttttttcagcttgcaattcttgttcttctaatttggctaaatggcgtaagcgtaaatttaaaatcgcttccgcttgttcatctgttaaattaaagcgtgcgattaatatttctttgggtttatcctcggtacggataatttcaataatctcatcaatatttaaaaaagcgatgagtaagccttctaaaatgcgtaaacgagctaatactttatctaaacggtattgtaagcgacgagtcaccgtttgacgacggaaggttagccattccgttagaatttgaacaagattttttaccgccggtttattgtctaagccaatcatgttcatattaacacgataacttttttctaaatcagttgtggcaaataaatgagccataagtgcatctgtatccactcgatttgaacgaggaacgatgaccaatctaattggattttcatgatccgcttcatcacgaatatcttctaccattggcagttttttattctgcatctgctcggcaatttgtgccacaatttttgacggagaagattgatgaggaagtgcggtaataattatttcaccattttcttttttccagacggctcgcattttaattgagccacgtccctgttcgtaaattttacgaatttcttctttcggtgaaataatttccgcttcagttggaaaatcaggaccttgtagtgcggtcatcaattgatctaaatctgcattaggattatctaacagcataattgtggcatcggcaacttcattaagattgtgcggtggaatatccgttgccatacctacagcgattcctgttgtgccgttaagcagaatatgaggtaagcgtgcaggtaaatattgcggttcttccaatgtgccatcaaagttggcttgataatttaccgtgccttgtcctaactcggataataaaatttccgaaatttttgataagcgagattcagtataacgcatggcggcaaaggacttaggatcatcaggtgccccccagttgccttgaccatcaacaagaggataacgataagagaaaggttgtgccatcagtaccattgcttcataacaagcactatcgccatgcgggtggaatttacccaacacatcaccaacagtacgtgcagattttttatattttgcactcgcattgagtcccaactcagacattgcataaataatacggcgttgaacaggttttagcccatcaccaataaaaggtaaggctcgatccatgatgacatacatggagtaatttaaataggctttttccgtaaactggcggagtggcatttgttcaatgccttcgtagttgattgtgttcatatggttgtttttcgtttacttaatgaaaataaaaatgtatttaaactatgattttaaaatcatatcgtcaatattatcctgaaagacaaatttacgatgataatcaaggtatttttctcttccttcaggataaattcgcattttatttttcgcatttgggttgatatgcaatttctcccaagtataaatgcttagttgtgtaccgcagattagctcgccattatccgtaaatgtgatatatccctgatcaaataaccaatcgtatgtcggagtaagagataaaccattcaaatgatccaatgcctcattttcttttccttccgagatacaaacactgtaaggtttgatatggcttgcttttaataacacatcatctttaattaaagtaaatgggcattgtggcatataatctaacacttttctgcgatattctgactgtccttttcttcctgtccgtttaactgcacctttcttttcatcaattaatttttctgtcatttgcgatgatgattcagtaagttttggatgaacaatggatctaaattgataatctaaaaatactctgaaataaaacaaaggtttttgctcttttccttgaattttctctggaagtagtttcaaaatagataaatagctaattttaggaagaattaatgctcgccatatattccaaatatcggcatctgaacgaatataacctctacgacgtgtaggattaccagtgactaaatcagacacatcataaattgaaaattcatttatctcattttttaaatcaacaatagaatttaagtaatcattataatattcggaaatatctgtgtgataatgttgttcttgtttgtgaaattcaactctagcatcatagagatatttcaataggttgcttttactaaaaaaacaattttcttgaatagttggatattctgctctcttattgttaacttgtttagctgccccccattcatgatactcaaaaaaatcacttaatctagcaccgctattgccaacataactaccgacatattttcgtgcttcaccattccctgtaaaaatggataatttgtttttacgatgaataaaactatcttccgcacgtaaattttgaatagcatcaatgataatgtaattttcgccattaacatggattttttgaaatttttgcatattcctattctccgtattgtgtaatatccatttgttttagcaatgcgattaacacatcaacgacaatactatttcctgcttgtctgtatgtttgagtgtcgctgacgacaatttggaaatcatctctaaatcccattaaacgtaaacactctcttggcgtgagctttcttattcttccttgattatgagtaacataattatcgacgccggcacggtgcattttgtgcattgtttgtaataaaggacgagctactgataaatcagtttgtgtactcgttttgaaattctttgttccacctgctaaaacataatcacgaattttgctggataaataatatttttcttcgacatcattaatgttaaaaataaactcatcaaaactgcttttatttattttgggcacaaaaacaaaatcaccatgccaattaaattgttggttggctttttgacataacattatatcgccattaatttgcgtatagcgtttttgccgatttttagaactggttacaaatttaatgcctttttctttaagaaaatatttgctatcagtgtaatcctctagaaaatcttgcatcgtacgctctaaaggaatcttagttggaaattggaatccgccttttggcgaggttttaaatcctacaacaaaaatacgttcacgatgttgcggaataccataatttttgctgttcattacttgaaaatataaatcgtagcctaagctatgaaaaacatcttttactacttgccaagtatttccaccatcgtgatttaataacccttttacgttttcataaataaagacttttggttgagtctcatttaccactctcgcaaaatcataaaaaagcgtacctcgagtatcttccaatccatgtcgttttcccaccatagagaaagcctgacaagggcttccacccactaaaatatctacttgatcacggtaaggtatcgcatcaaaagtggtaatatcagaatgccaatgttcttcagataaatcgtaattggctaaataactttttttaacgtggggatcaatatcgccagcaaaaacaatacagtgatttagttctaaacgtttgaaagcttgttctattgcaccaataccactaaacgtcgtggctaagcgtatttttgcattaggatttttaaatgttttaaaacgccaatcacactcatcaaataagggtaattcaaaatttaggtttgttttatccacgagatttgtcatataaatataaaataaattttctatttttagagagtacttaaccaaataattcacacagcaaaatctacttgatcaccgttattttgcaaccaaattttccgatcttcggaacgttttttagctaataacatatccatcaattctaacgtagatacatcttcttcgtggggttcgtaggttaattgcaccaaacggcgagtgtttggatccattgtagtttcacgtagctgattaggattcatttcacctagccctttgaaacgctgaacattgagtttgcctctcttattttttaagcgtgctaaaatgctctctttttcattttcatcaagagcataaaaaacttcattacctaaatctatacgataaagtggaggcattgcgacataaacatggccatgttgaactaattttggaaaatgacgtaaaaataaagcacaaagtaatgtggcaatatgtaatccgtcagagtcggcatcggctaatatacaaactttaccatagcgtaattgagataaatcttcgttgtcaggatcaattcccagtgcaatagcaatatcatgaacttcttgtgagcgtaacacttgatctggtgaaacttcccatgtgtttaaaatttttccccgtaatgggagaattgcttgatgttcacggttgcgagcttgtttggctgagccaccggcagaatctccttctactaaaaaaagctccgttttacttaaatcttgttcactacaatccgctaattttccgggtaaagcaggaccactgactaattttttacgcacaactttttttgctgcacgtaaacgtctttccgctgaacttatcaccatttttgcaagttcttcggcatcttgaatattttgatttagccataaactgaaactatcttttacaacgccgccaacaaagaccgcactttgacgagaggaaagtcgttctttagtttgacctgcaaattgtgcatcgtgcatttttactgataacacataagcacagcgatcccaaatatcgtcagcggttaatttgacatttttgggtaataggttacgaaactcacaaaattcacgcatagcatcaagcaagccttgacgtaagccattgacatgagtacctccctgaatggttggaataaggttgacataactttcgttaagtaattcgcctccctcaggtaaccataataatgcccaacttgccgcttctttattcgtactaaaattaccgacaaaagggttttgtggtaagagattatagccattaacattttccattaaataatcagataaaccgtcttggtataaccaagtatcctcagtgttattgattttatcgataaatttaatttctaatcctgaacataaaactgctttagcacgcaataaatgacgtaggcgactgactgaaaaattagcactatcaaaatatttcggattaggtttgaagtgaacggaggtcccggttgtacgctttccgcaagtgccgataatctctaattcttctaccttaacaccgttttcgaaggcaattttatagatttcaccgttacgttttacctgaatatctacacgctcagataaggcatttactacagaaatacccacaccatgcaaaccacctgcaaattcatagtgcttattggaaaattttccgccagcgtgaagtttagttaaaataacttcaacaccggatactttttctgttgggtgaatatcgacaggcattccacgcccattatcaatcacctctagagattggtctttatacaaaataacttcaattttggttgcgtgccctgcaagtgcttcatcaacactattatcaataacttcttgccctaaatgattagggcgagacgtatccgtgtacataccggggcgaagttgaacgggttcaagatcttttaaaacggttatttcttgtgctgaataatttgtcataatgccatgtgatcagtaaaaatttggagaattttaacaaaaaaagtgtcacctttcatcttgattgttgtttatcttcttttgaattccaaggagcaacccagaataggcaaagcataccgggaatggctaaccagaaacaaaaccaaaaatagtcatagtatcccaagtagttgattaaaacgcctgcttgtgtattgaaggtaactcgaggtaaggcggcaaagctggtaaataaagccagttgagtggcggtataaagtggattggtttctcgtgccataaaggcgacaaaggcagacgtacctaagccaataccaatatattcagcggcaacgactaaactgagagaaatcagagcaaagttatctatttcctgaaatggacctaattttgccaaccatgcaaagcctaaaattgttacaatttgtacaacaccaaaaagccataatgcacgattaattccgattttcagcatgatgacaccacccacaatactggcgatgagcatcggccacaaggaagaatttttgaccactatgccaatttgggtcatgttataacccatatcgagataaaacggcgaaatgagggcggttgccatactatcgccaattttatagagaaaaataaaagcgagaataccaagtgcggaagacgtgcctttgcgtgtaaaaaattctttgaacggttcgatcacattctcttttaaagtgcggtcattttttagctgaatttgaggttctttacttaaaaataaggtcataaaaataccaggaagcatgaagagtgcggtaattaaaaagaccgttttccaaggtaaatagtctgccaaaattaaagaaagtgagccgggaacaagccctgcaatacgataggcatttacatgaatagaattacccaagcccaattcacgatcagagagaatttctcggcgataagcatcaagtacaatgtcctgacttgccgaaaagaaagacaccagtactgcaatacctgcaatcagttgtaaattaaaggaggagcttggttgtaaaaaaccgaataaagcgagtgaaatgagcagtaaaacttgcgaaatgagtaaccaacctcgacgccgtcctaaaaagggcggtataaatcggtcaagcaaaggagaccatagaaatttccaagtaaaaggaagcgttgtagctgtaaaataacctaaggtttccaaatctacgtgttctttacgtagccaaagtggcaataaggaaatgataatataaaaaggtaatcctgagctaaagcctgtaaacacacaaataagcatattacgactaaagatttgttgcagcattgagtgagatttttccataatttttccgtatgtataaattttttcaacagtatagatgattttttcatgttcatgataggatttttttattcacataacaagtagataaaatcttttacgcaaacgtttactatttgaaagtttcaggtaaaatacgcgcactttttttattcattttaacttgcctataggggacgctatgtctttagaaaaaacttttgagttgacgaaacgtggttctaacgtacgtcaagaaattattgccggattaacaaccttcttggctatggtttattcagtaattgttgtaccgaatatgctgagtgcagcgggatttccagcagaaagtgtgtttatagcaacttgtttggtagcaggattaggttcaattttaattggcttatgggcaaatgcaccgatggcgattggttgtgctatttcattaaccgcctttactgcatttagcttagtgttgggacaaggtgtgagtattcctgtcgcattaggtgcggtatttcttatggggatagtctttactttaatttctgcaacaggtattcgctcttggattttacgtaatcttccgtcgagtattgcacatggtgcaggtattggtatcggtttatttttgctacttatcgctacaacgaatgtgggtattattgtagccaatcaaaatggcttattagttaagtttggtgattttacgtctttctctgtgctgatgtctttggttggacttgctgtaattattggcttggaaaaaatgcaagtcaaaggtgggatcttatgggttatgatcgcaattacgatcgcagggcttatttgggatcaaaatgtacagtttaaaggcgaaattttcagattaccgacttttggtgaacaatccttatttttagaattggatattatgggagcattacaaccggcaattttacctgttgtttttgccttagtaatgaccgcagtatttgatgcaacagggacaattcgtgcagttgcaggtcaagcaaatttattagataaagatggtcaaattatcaatggcggcaaagcattaacagcggattccgtaagtagcttattatctgggacacttggtaccgcacctgccgctgtatatattgaatctgccgccggaactgctgctgggggtaaaacaggtatgacagcgattgttgtcggtatactgtttttattaatgctatttttccagccattagcaagtttggtgccaaactatgcaactgcacctgcgttaatgtacgtaggattattaatgttaagcaatgtcagcaaacttgattttagcgattttgttggagcaatgagcggactggtttgtggcgtatttattgtactaactgcaaatattgtaaccggaattatgctaggttttgcaactttagttatcggtcgtttagtttgtggtgattggaaaaaacttaatgtaggtacagtcatcattgccattgttttggttgctttttatattggcggttgggcaatttaattgtatataaaatgttaggtgggtaagcttagtcagctctcgaaagtatctacaaaaaaccggcgataacaacactgctatcgccggtttagttttatatgatgaattagttaaatacgccgctgatgccgacacggaaaccaactcggcctctactatcagaagaaatgccgccggatatggcatattttccgtttgcggaagttctaccgaggtttaaagagaccgcactttcgctgctataacgagcggcaccggcggcgtaagaccattttcccgggacgaaagggacttctttgaaagccatagcggcggcgataccggcttttgcgtctttgttgacctcttcaacacgttggttggttgcgtgtaattggctaccgtttaccgcatcggttgagcgatgagaaagcaaaccggcagcaacattttgaatacgrcgttcattgcctttgytkcccacggaaacgacrcctttcgcatcaacgccagcgtaattgccgtcgactttgccgataccgccggtagtctcgcctttttccacataagcggaactatcgcctaggaagacggagttattagtggtattatgaatattattacctacaacaacggtgtttttagaagtttgttctatgatgttattatgccccatagaaaaagagccctcagcgtaattattaatattagagccgattgatacaccattctcagcagttgtatttataccgctaccaaaacttaacgcacgtttaccagatgcctttgcttgaggaccgatcgcttgagcacgttcaccacttgcttgtgcactccaaccaagagcggtagaaagttgtcctgtggctttagcatctcgaccaaaggcattagcccaaccactagcgacactacctctaccaaaagccaaagatgaatccccattcgcctttgcttcatcacctagtgctactgcaaaatttcctcctgctttagaatgtttacccatggcaatggcttgtgtatgtgcgtttgcctgaaaacccattgcaacagcataagcttgtgcctctgctgtcttaccaaccgcagttgctccttcatgtgctgcatttgccttataacctacagcaaccgcggactcgccgacttttgagccttttccaatagcaacggctttgnnnnnnnnnnnnnnnnnnnnnnnnnnnnnnnnnnnnnnnnnttcaccaatataaatcccactgttttcaatcttaatatgattattactattayttgrytgttgascttgagccatarccgaatkagcagytaaaacaasyaccgcagttaaagakaaataamawwttttcacttgaaataaatccttaaaaaaagagttaacatagaaaaatcataaaaaaacaaccgcactaagaggcgataatttatgacacgccttaaaaagaggtagggggacctaccaaagcgggcgaaattttaagcggggggggggtactgtcaatatatttttttacaaaatgtttacttttttaacaaaattgaaacggaaaaacatttgtcgaacacgaaaaaatattcatttgtttttgtgttatggaatgcagtagaaagaagaaagaaaaaatgaaatgataattggcggaacggacgggactcgaacccgcgaccccctgcgtgacaggcaggtattctaaccagctgaactaccgctccgcaataaaagaaataataaggggaaatttggcggaatggacgggactcgaacccgcgaccccctgcgtgacaggcaggtattctaaccagctgaactaccactccgtaaaagtggagtgcataataatagtgaatagatttttcgtcaagttatttttatttattatgcacttatttttgctaagtgttgattaagcaaacattaatgcatcgtttcttttgtatttcgcttaaaccataagcaattttctttgcttttttggtttagcaattttagataatcttggtgagccagtttttcttcttctgtgggtaaaagtaatttgaaattatgagtattggtagtatgttgatgaatattttcttccatcgttataatcggcgtatgttcttcatcaccaaataaactggtttgcccccctgtcatggctaaataaacatcacctaaaatttcagcatcaagtaatgccccgtgcaatgttcgtttactgttatcaatatttaatctgtcacagagtgcatctaaactattacgctttcctggatacatttgacgagccatttgtaatgtatctgtgattaagcaaatatccgctgtattgatattgaaattgtgttttttaaactcataatccataaaaccgatatcgaaaggtgcattgtgaataatgagttcagcccctttgataaaatcaataaattcctgtgcaatagctgaaaaatccggtttatctgccagcatttcatcagtaataccatgtactttaattgcttcaggatcaacgagacgatccggttttatgtaaagatggagttttcttcctgtgtagcgacgattgatcatttcaactgcaccgatttcaataatacaatgcccttcataatgtgcaccgaattcgttcattccggtcgtttccgtatctaggataatttggcgattttgtgtgatttctaatgtcatactattttgctgttgcttgaaatgaatttgcggtattatcaccccatttgagaaaaattagtagaaaattatgttaaaaaaaattgaaatttttaccgatggatcttgtttgggaaatcctggggctggtggaattgggattttgttgcgttataagcaacatgaaaaaaaactgtatcaaggcttttttcaaactacgaataatcgtatggagttaagagcggtgattgttgctctaaatagcctaaaagaatcctgttcagtgattttgtatagtgatagtcagtatatgaaaaatgggattacaaagtggattttcaattggaaaaaaaataattggaaaaccagttcaggtaatgcggtgaaaaatcaagatttgtggtgttcattggatcaagctattcaaaaacatcaaatagaatggcgttgggtcaaaggacataatggacatcgagaaaatgaaatttgtgatcagcttgctaaacaaggtgcggaaaacccaacgctggaagacgttgggtatcgagctgaatagaacaggctaaataaaactggcgagaaagcgtagtcgatatgaatgatttgactccaaaatattcgcctttatttttcaggtaatttcgcaatgactgcgtaaccttctttcaaaccttcaatttgataggtaacatcggcacaaataaatgcactctctccctgttttaattcaagtgcggtgtgatttgcggttatttttaatgcaccttgcatgacgagtaaaatctctgcgttacttgaggttagggtgtgtttttgttgcacgctataacgtacgtttgtcatggcaaaatctttagcgggcgtagtgtaagtaaagatgtcttgatcttgaggtgccttaggaataatttgaggcgtaatttcactgcaatcaactatttttaatagctcaccaatatccacatgttttggtgttaatccgccacgaataacattatcagatcctgccattaactcaatattttgacctcgtaaataggcatgcggaatgcctgcatcttgataaattccctcacctatattgagatgaacaatattaaataaatagaaacaaattaatccagcatccagtttatcagccggtatttccattgcttcaattgtatataaaacccaatagtcgggattatttaatttcagttttccctgtctataagcaacctgattttcagtaataataggggatagccacgcagaaagttgagtttgatcagcttgcataattgttgcataaaaactgtgtaagtcttgattttccagctgttgagcaagtgcggtcaaagatggacgggcttttaaggtttcaagaatgtttgttttttgtttgaaaccatgcaacagccaaaaatcagacaatgcaatcatcatttcgggtttatggtttcgatctttataggttcttttaggatcttttaacgctattcctgcaagattctcttgtgcaaaacctatttccgcttgtttttttgttgggtgaagttgaattgaaagcggctttgcaacatctaaaattttcagcaaataaggcaattcatgtccaaaattcgttagggttgctttccctaaaacttgtgggttttgtagtaagaaatctgttaacagtactgatttttccgacatatttaatagagaaggggatgaggaatgagcaccaagccaccattctgcataatattggttgtgttgtttttctatgtttaacaactcgggaaggtaattttgtccaccccaaacatagtgttgtagacgaccttgtagctgataaatggtattcattttgctgtccttttatttgataatgacttataaccgccgaaaaaatgaactattttttctatatcttgtaggttttctggtgaaatcatgagatgttttttattttttaactcaataatcagagtgttattttcaagcagattaatttgccgaattttagcataatcaatataaatattttcaaagaaaaaaccctgttctttcagtaataaaacaggaaagcgaataaaggctatatatagactgagaagaatgcttatcgctaagaaatagagggttattgcgttaatttgtcctgaattttgatagagaatgatggcaatgagtacaataaaaataagtgcatctatttttgctcgctttttcaaccgcactttcaatttcgttgttcctttaagatagtccatcataaattgatcgtaaaaggcataaagaaaaaaacagcaaatacctacaataagaaaggcattaaccatatattacattcctaaaatgaaaaacttctcccgtgcagggagaagttttcggataaattaagctaagatacctgttgcggcacctaaaataccgataataaagataccggtaataatccataatgcgttaatacggttgcgtaataaccacatacaggcaaaagtgaacaataacggtaataatcccggcatcaaactatcaagaatattttgtacagtcgttgtttcaattgtgccgtcttgtttttcaataacggatacgactaatggtacattaatactggtccatttctgcactaaagcccccataatgaacaaaccaagaattgatgcaccttccgtaagtttttgcaacaatccgccactcatatcctgaacaacgtccaagccttttttatagccataagtaacaccatagtaacgtgtcgctaaacgaactaaattgaatagcacgaagaataaaataggacctaaaatacttccattgatcgctaaacctgcacctaatgcagcaaatacaggtcttgcagtaccccaataaattggatcaccgacccctgccaaaggtcccattaagcctactttgataccgttgattgctgcatcatcaatttctttaccgttcgcacgttcttcttccatcgcaatagtaacgcccaataccggtgcagcaacgaaaggttgcgtattaaagaattctaaatgacgtttaattgcatctttacgttcttgcgaatttggatccggatataaacgtttgatcacaggaaccatagaataggcaaagcctaatgactgcatacgttcgaagttccatgaaccttggaaaatgtttgaacgaagaacaacggcatttaaatcactttgggttacttttttcatttctgttgtcattttttggattcccattaatctaatctgttatctaaatcattattgttatttgctacaacttgtaccactttactttgattgtatttcgggtgaagctgaatataaagtgcggccatgattgcaccaagtacaccaagagcaacaaggttgaaatcggtaaatgctgcaataacaaaaccagcatagaagaatggcattaaatgacctgcacgcatcatattgatcaccatggcataaccgacaaccgcaataataccaccggcaatttttagaccgtttgttacgactgctggaatagcgtttaacatatcttgtacaacatcggttccagctgtcaacgcaacgacaagtgcagggattgcaatacgcattgcttgtaataatagtgcactacgatgaatccaatctaagcgggttaagttaccgtcttcaattgatttatcagcagcatgttggaagccgacagttaacgcacgaacaacataggttaatacttgacctgctgcggctaatggaatagcaattgcgataccggtgctaatatcttgtccaccgacaataactaagattgttgaaacaacggaggctaaagcggcatccggtgcaagagccgcaccgatattcatccaacctaacgccaagagttcaagtgaaccgcccacgataatcccagtttttatatcacctaagactaaaccgattaatgtacaagcgattagtgggcgatgtgtttgaaattcatcaagaattgatcccataccagagatacaggcaacaataaagacaagtacgacttgtaaagttgaaatttccatttatgtcttccttaaattaaattattttttttgagtaaatccatcatatattgacgactgtcgttagatactttacgaacatctaattcaatgcccatcgcatcaatggctttgaatgcggcaatatctttatcatcaacagccaccgcactcgtaatcatttttttaccgtctttatatgccataccaccgacattaattgatttcatatcaacaccggcttctaacaatcttaaaacatcggtaggattagtgaataatagcatcatacgttcatttgcatattcaggattgttatatacacggatcattttttctatattcacaacatgtgcggtaactcctggaggtgcaacgcttttcagcatggttgagcgaacttgatctttggcaacatcatcattgactacaacaatacgtgttactcgactttcttttgtccagcgagtggcgacttgtccatggattaaacggtcatcaatgcgagctaaacctacaatgagattgccttcttgttgtttgactgcgatttgaggttgttcagggactggttgtgagagtgcggtagtttcagccgatttttcttcatatttcaaagcacgaacaccagcacggccggtttctaacgcaatgctcactaattcttgtaagctagggttatcgtcacgtgccataaaagtttccactaacataggcacatttacaccggttacaatatccatattagtgttatcaccaattacacgatttgccgcattaaacggactgccgccccaagtatccactaaaaacaggacttcatcgcaatgtgctaatgttgtacttaatttttcttgatacttcgtcataatcgtttcagcattttcgcctgaaacaaaatcaatagttgcaacattctcttgctcaccaatcaacatttctgttgttttaagcaattgttcagccgcaacaccatgcgttgctatgataatcgcaatggacattcggactccttcctaaaagtattaaattgatttaaagggcaggtattctaaaggaagttttattttaataatgtgatacagatcacattttaagatgttttttgggtttaaagtgtgatgtaaatcacgctgattgcaaaaaaaagtcaaataaatgtgatttagttcactctttactcgacttattcaaaaatgcacaaacaatcaatttaacgtactttagcaagattgtttttttgagtttttaataattcagcatgtgctttcttttgctcttttattttattgttaatttctctacgctgtttagacagttccgcattacgaattgtataatcgtcaacccgagtttcgtaatcatcacgcatactttcaataatcgcacgcacatcagcaatactcatatcattacggatatattgattcagattatccaataacaacacacgcttttgattatcacgaattttacgattattgtcgtctatgtcgcgtaaaagtttgttttttaaccgatacatacgtacatactctaaaacttcttggaaagattgtttattgatattttccatttttttcttctcttttattaaatgaaacttcggctaatttaactttttttcccttattcgtcaaagtgttctctaggaattttcttgagctgtaaaaaattcagaaatttattaaaagttagttgattaagctgtgacgagatgatagaaattaaaaattctttttataaaaccaattaggataaaaatatgatgcaagtatttaattttagtgcaggacctgcaatgatgccaaaagttgttttggaacaggcacaacaagaattgttgaattggctggatcagggtacttctgtgatggaagtcagccatcgtggtaaatattttatggaaatgattacacaagctgaaaaagattttcgtcaattgtataacattccggaaaattacaaagttttatttttacaaggtggggcaagagggcaatttgctgctattcctatgaatttagccaataaaaaaggtaaaacactttatcttaccagcggacattggtcggcaactgcggctaaagaggctcgtttgtttacagaggttgatgaaattaatattttacttgatgggaaattagaagtaggagaacttgattttagccacattgcttcacaatatgattatgttcattattgtccgaatgaaactattagcggcgttgagattgttgacgtaccaaatgtaggtgaggcgatattgattgctgatatgtcttctaatattctatcccgtgaaattgatatgagtaaattcggcgtaatttatgccggtgcacagaaaaatctcggtccggcaggtatcactattgtgattgtgcgtgaggatttaattggtcaggcaagaaaagaaacaccgtcaatttggaattatgaagtccaaagcaaaaatagttctatgattaatacgccgccgacttttgcttggtatctttgttctcttgtattcaagcatttgcttgcactgggtggtgtcaaagaaatggaaaaacgtaatcaggaaaaagcaaaattattatatgattttcttgatcagagtgatttttatcataatgttgttgcacctaaaaatcgctcattaatgaacgtaacatttaccacaaataatgatgaacttaatgcgaaatttgttgcagaagcgacagcttgtggattgcaagctttaaaaggtcataaggtattaggtggaatgcgagcttcaatttataacgcaatgccgattgaaggcattaaagcattaattgaatttatgcgtaaatttgaagcagaaaataactagaattttatagcaaaaacgaccgcactttaacggttattaatttcaaataaggatttttatgcaatacatcaacatcgccaacgaaggcgtaaaatccctgtctccttaccaggcgggaaaacctattgaagaattagaacgtgaattagggattagcaatattgttaagcttgcctcaaatgaaaatcctttcggttttcctgagagtgctaaacaagctatccaaaggcagttaaatgatctcacacgctatccggattccaatgggtttgaacttaagcaagtgatttcgaaaaagttcggtttgcaaccagaacaaattactttaggtaacggttcaaatgatttattggaattaattgcccatacttttgcttcggaaacagacgaaattatttattcgcaatatgcttttattgtctatcctttggtgacaaaagcgattaatgctgttgcacgagaaattccggcaaaaaattggggacatgatttagacgcttttttacaggcgattaatcataaaacaaagttaatttatatcgctaaccctaataatccgacaggcaattttttgactgaacatgaaatagatcatttccttgctcaagtacctgaaaaagtgcttgttgtgctggacgaagcctatacagaatttacagatgaaaaagagcggttaaattcttttaaacttttacaaaaatatccaaatttaattgtttctcgttcattatccaaggcgtatgggttagcaggcttgcgtatcggttatgcggtatcgaaccctgaaattgcggatttacttaatcgtgtacgtcagccttttaattgcaatgttcttgctttagtttcagcggtagccgtgatgcaagatgatgcttttgttgaaaaagtggctgaaaataatcgtattgaaatggttcgttacgaaaatttttgccgacaacaaaagttagattatattccatctaaaggtaactttattactattgattttaaacgtccggcaaatgaaatttatcaagcattgctacataaaggggttattgttcgccctattgccggttacggtatgccgaatcatcttcgcgtcagtatcgggttaccgaaagaaaacgataagttttttgattcattagtaaaagtgttaggcgaggtctttgttgggtgaagaaaagtaatttatacttttgcaatatccctatttacaacttaagaaagcaacataattttatggaaaaattaacgttatctccaattagtcgcattgacggcgaaattaatttaccaggttcaaagagcttatctaatcgagctctgttattagccgcacttgcaaaaggaacgacacaggtaacaaatttattggatagcgatgatattcgatatatgttgaatgccctgaaagcattgggtgtgaattaccaattatctgatgataaaacggtttgtgttgttgaaggtattggcggtgcatttcaatggcaaaatggattatctttatttttaggaaatgcagggacggcaatgcgtcctttagcagcggcactttgtctaaaaggtgatacggagtctgaggttattttaaccggtgagcctcgaatgaaagagcgtccaattaaacatttagtcgatgcgttgcggcaaaccggagcaaatattcaatatttggaaaatgaaggttatccgcctcttgctattcgtaatcaaggtattttcggcggtaaggtacagattgacggatctatttcttcgcaatttctgaccgcacttttgatggctgcccctctcggtgagggggatatggaaattgaaattttgggggaattggtttctaagccttatattgatattacgctggcaatgatgaaagatttcggaatcaatgttgagcattataattatcagcgttttttgattaaaggtaagcaatattatatttctccgcagacttatttggttgagggggatgcttcttccgcttcttattttttggcggcagcagcaattaaagggaaggttaaagtaacgggaattggcagaaattccattcaaggtgatcgtttatttgcagatgttttggctcaaatgggggcaaaagtaacttggggagaggattttattcaagttgaaaaatcagagttaaaagggattgatatggatatgaatcacattccggatgcggcgatgactattgcaatcaccgcactttttgctcagggtgaaacggttattcgtaatatttacaattggcgtgtaaaagaaacagatcgactaacggcgattgcaactgaattgcgtaaactcggtgctgaggttgaagagggggaagattttatccgtattcagcctcttgcattggataaatttaaacatgttgaaattgttacttataacgaccatcggattgcgatgtgtttttcgctcattgcattatcagatacatcggtaactattttagatcctgcatgtactgcaaagacttttcctacctatttttccgagtttgagaaaatcagcaaaaatcaatagattaatgggcaatttattgcccgtttttttataattaaattctatattcaatttgtgtaataagtaaaaagtcattaaaatgggcgagtgtttattcaattcttgtaatattttattcgattatcgaaaaaaatccgctttgtgtaattactacgccggaggctgtaattcagtatggtgatgaacattttttaatgttaaagattttatttttttccgttaggagttagtcctcatgagtattcaaactcacataaaagcaaaacgttctcatgtgtttttcttaaaactatttttgggcatcattgtgcttttatttgccattatgatcggtttaaaagttgcttcaaaaatgcttattggcaagatgatagccagtatgcccgaaaaaacgacaccggttacggcaattacagttgtaccaactacctggacacctgttatcgaaacaacaggcttggtgagacctaatcaaggtgcggttttgagtgcacaagcaccagggactgttgcaaatatatttatccaatcaggacaacctgttaaaaagggagatgtgttggttgagttggatatttctgttgaacaagctaatttacaggcatcagaagcaaaattaaccacagcaaaacaaatctataaacgctatctgaatttgtataaaacgaagagtgtttctcagcaagaattggataatgcaaaagccaattatgagtcgttggtagcaaatattaacgccttaaaagcagcaattgagcgtcgcaaaattgttgcaccttttgacggtattacaggtattgttaaagtgaatgttgggcaatatgttaatgtgggaacgcctattgtacgtgttgaagatacaagttctatgaaagttgatttttctattgcacaaaatgagttggaaaagttgtttattggacaaaaagtgacgacaacaagtgatgcacgtttaggtgaaacgtttggtgcaaaaattaccgcacttgaaccagcagtgaatgcagcaactggtttaattgatgtgcaagcaactttcgaagatgaagacagtcgtaagttactatccggtatgtttatgagattgcgtgttgcattgacgaccgaaaaagatcaaattgttattccgcaagtaggtattagctacaatatgtatggtgaaagtgcttatgttttgaccgcactttctgaggaagacaagaaaacattacttgataacgaaaaatttgcttataaagacagtatagacagggtttatcgagtaaaacaaactactgtatttactaaagatcgtcagggtatttatgcacaattaaaagggcaagatattaagccaggtgaccaaattgtggttggcggtcagcaagctattaccaatggtagtttagtggtggttgttgataaagaaacaataggcacacaacaacctgccaagaaaactaatctttaattttaggtaggaatatatccaatgaaatttaccgatatatttattcgtcgtcccgtattagctgtgtcaatcagtttgcttatcattattttagggttgcaagcaatttcaaaattgagtgtacgtgaatatccgaaaatgacgacaacggtaattactgtagcaacggtatatcctggggcagatgctaatttgatgcaggcatttgtaacctctaccttagaagaggctattgcccaagcggataatattgactatatgtcatcaagcagtgcggctaattcttcgataattacagttaaaatgaaactgaatacagatcctaacggtgctttagctgatgtattggcgaaagtgaattctgtgcgttcaagattaccgcataatatagaagatcctgtgatttcatcttcaacaggtggtacaggaattatgtatatcagtttttattctgataaattggattccagtcaagtgacggattatatcgaaagggttgttaagcctcagttatttactattgaaggggtagcgaaagctcaaattttcggggcggctcaatacgcattgcgtatttggttggatcccgaaaaaatggcggcacaaaatctttccgcactggctgtaatgtcagctttatcggctaacaatgtgcaaacagcggctggaagtgcggatggttattataccgtttataaaaataaagtcgggacaaccactaattctgttaaggatttagaaaatttaattgtttattcaaaagacgataatcttgtacgtttgcgtgatattgctactgttgagctaaataaagaaagtgatagtacaagagcaacagcaaacggtgctgattctgtcgttttagctattgaaccgactgcaacagccaatccattaacggtagcggaaaatgttcgtccattgtatgcacaaattaaacagaatttaccaagcagtatgtattctgatttgctttatgatcgtactatcgctatcaatagttctattaatgaagtgatcaaaactattattgaagctactgttattgttttggttgtgatcttactatttattggttctttacgtgcaattttaattcctattattactattccaatttcattaattggcgtaatcatgattttgcaattatttgatttctccattaatttgatgacgctattggcaatgatcttagctattgggttagtggtagatgatgcgattgtggtattggaaaatgtggatcgtcatattaaagccggtgaaacaccgtttcgtgccgcaattattggtactcgtgaaattgcaatacctgttatctctatgacaattgcattgattgcagtgtattcacctatggcactaatgggcggaattacgggatctttatttaaagagtttgctttgacactggcaggtgcggtctttatttcaggcattgtagcattaactttatcaccaatgatgacaagtaagttactaaacaataatgcaaaacccaatcgtttggaacagcaaattgaaaaatcattaactcggttaaccaatgggtatgtttatgttttaaatttagttatggctaaccgtaagtgtatgcttgcttttgctgctattatttttgccatgttaccatttttgtttacttccctttccagtgaattgacaccagcggaagataaaagagcatttatcgctattggttccacaccttccaatatgaatgtagattatgctcaggaggcaacgaaacagtatgttgatctgctgaacaaaacagaagaagtacaatttacaatgtctattgccggttttccaagttctagcgatacattaaatgttgtaaccttgaaagattataaagaagatggtcgtagtcagtcagagattatagaagagttgaatcgaaaggcaacgcaaattccggaagtgagtgtttctgcctttaattttcctgaaattgatacgggagaatccggagcaccgataggctttgttattagtacagcaaataactatcgtgatttagcaccggttgcagaagcatttttagcgaaaatgcgtgaatcaggcagatttgtttatacgaatctcgacttaaagtttgataccgctgaaatgcaaattagcatagataaagaaaaagccggaagttatggtgtttctatgcaacaaattagtagcactttagggagctatttatccgcagctacggtaagtcgtgttgatatagacgggcgagcttataaggttatagcacaagtcaaaagagcggatcgtttaacaccggaaagtttgaaaaacttctatgtatcagcaagtaacggaaaaagtattccgttgagtagcctaattactatggaattggtaacacaaccgacatcattgtcaagatttagtcagttaaactcggcattaattcaagctgttccaatgccgggagtttcagtaggtgatgcggttcaatggctgaaagatgcagcgacggagttactgccaaaaggatataactatgattttcgtggcgaagcacgtcagcttgtacaagaagggaatgcgttagtaataactttcgtgttagctgttcttattattttcttagtattggcaattcagtttgaatctattcgggatccattggttattatggtttctgtgcctttggcggtaagtggagcgttactggtacttaacttcttgagcttattaactgatatgagaattttacggttatcaggagttaccctgaatatttactcacaagtaggattaattacactggttggattgattactaaacatggtattttaatgtgtgaagtagcaaaagaagaacaactttatttgggtaaatcacgaattgatgccatcactgaagcggcaagagtgcgtttacgccctattttaatgacaacagcggcaatggttgctggattaattccgctcttgttggcatcgggagccggtgcggcatctcgttttagtattgctatcgtattagttgcagggctttcaataggcactttatttacgttgtttgtattgcccgtaatttattcttatattgccagtgaacacaaacctttacctgagtttgatgaaagtataaaaccattggcgactgatcagcatcattaaattcaagcgataaataaccgcacttttaagtgcggtttattatttcaactattttatttgcaaacgcaattgggttttctaaatgagcattgtgtccggcacgttcaattaaaaataaatttaattgattttcttgtgccattttcttaaatttttcatccttttcaccacagaaataataaataggcagagaaaaagaccgcacttttttatgaaaagatggttgtttggcaagtgacgttgcgattagcatttttgcaatattttgacctgattgatgtcttcgttgagaaattaattgttttctctctcgtgcagataggtgagcaaaaacaggttgctgataccaatcatttaaaaccttggacatagtttcttggctaaaacgttttgcccaagccaaatcattctgccagcgttcaaggcgttgttgttcattttctacgcctaaatttgcaccttccaagataagtgcaacaagtttactttgtggatatttagattgcagtgcgtaatttaaggcaagacgtccccccaatgagtaaccaacgagaatataaggcttatcggcaatttttgtggtaatttgtcgggatagatattgtgcactttgttcaaaatcttctatgtgatagtttgtttgttcaccatgaaagggcagatctaaacatagataagattgtgaggaaaagtgcggtagattttttttaagttcttcgataatgtattgccaatcttgttttgttccaagtaatccatgtaaaaaaactaagatcggcatcatacgctatacctcttaaacaccgattaatgcatgaccaattttgtcaataagatctttatagatattactaccatcatttggattgactttaatttcgatgatggtcgtttctctgcgtgagtaggcttgtttaagtaccgtagccagatcagcccaagtataagggcgagcatatttgagatcgaacatagctgcaatatgtgaaaactcaagatagtgcgacatacggtaatatttttctttcactgcgatatcaacaggaagcatatcaaagattgctccaccattgttattaatgacaaagataattgccggttggtttagttgtttgaataatgcaaaagagtttaagtcgtatagcgtggaagtatcgccaatcattgctaccagtgtttgttcggaaccaacagcaattcctgccgcagtcgcaagcaaaccatcaattccacttgctccacgattagtgtaaattggataattggcggaaggttggcttagtgcatcggcaaggcgtacaaataaactgttccccaaaaagagaacgctattagattttggtagtaataattcaatattatgtgccaatgaggcctcatttaaatttgaaccgacacgttgtttgataaattctgcacagaatttagccaatgctaaaggctcgagtaaccaaggttttttccgcattggcggatgggctcgtaaccaatgatgcggtttagcattgaaacgtgtatgagcatgatgatagggatcaacagctttttgattattttcaataatccagtattcacctttaaattctgctaagaattgattaattcgctttccaataaatcctgagccaaattgaatgacgatttcagcttgtaacagtttttttctgacagtttggtttgccagccaaatatctgcataaggtagggttggtttaacatgggattgaatgtctgtaatcattatccaacccatattttctgcccattcagcaattcccattgcctgttcggaaggtaagcgtccaacaataattatgccttttttggttcgccattgatcccaatatttatgtgtaataacttccgtgtgttgttcttgatgttgaatccaatttttgttttgtgttagccaagattgaatattactgagccaaggatgaagatctatttcatcattattggcattatagagcggttcagcaaaagggacattgatatgaataacacccccttgcttttgtcggaaacaagcctgatctaaaactgaaattagccattgagcagaatagttttgacttggacgaggcagatttatgctggcgatcgggtattgtgcaaacatattttgttgcaaaatagcttgatttgcaccgcactcaagcaattcaggaggacgatctgcagttaagataattaatggcacatctgtttggcgtgcttcaataattgcagggtaaagattagctgttgctgtaccggatgtaacgattacagcaaccggttttttgctcgctttagcaattcccaatgcgaaaaatcctaagcctctttcatcgaaatgagtatgacaggtgccacgtccgttttcctgtaaacggatagcttctagtgtaagtggtgtggagcgtgaacccggtgcaatacaaaaatgagaaacaccttgacggctcaaggtttccaaaataacttttgaccaacaacggttaaaaacgctggctgacatattttctactccgtttctttctgtaatagggatattagccctagtgctttacgttctatttcttgccattctaataaaggaatagaaccttcaacaataccggcaccggcaaatatacgaatataatcttgttcaataaatgagctacgaatagtcacacaaaactcagattctgtttcagtcattattcccaatgcacctgcataccaagtgcggtcaaaagtttcggtattttgcaagaacacttttgcttctttttgtggtaaaccggcaatagctgcggttggatgtattgcatttaaacataccgcatcagtatttcctgctttaagtcgggcagaaatttctcgttttaaatgttgaacttggcgtagttgcttaatttccagttcactcaccgtaatttcctcaacatagggtataagatgttgacaaatgccctctacaaccaagctgttttcataaatatttttcggatcttgtaataaccactgagcttgttgctgattaatatgttcatcatttgttataaaagctgtccctgccaatgcttcagtgattaggcgattttctttacgaacatataatctctcaggcgtggagcctataaatgcttgtgtattattttgagcaaacaaaaaatgatagcaacctgtattatatttctcactttcggctaaaaaatccttagcgtttaatgggctatcagttttaaagtcggtttcatttgccagcacaactttagtcagatttttttgcttaatttcatgcaatgctttttctacccaaagacaccattctgtttgatttgcttttgttgttatcaattgaatagattgatgaattgggtttaattgaacttgtttttccaaagaataaataatattcaacagatcatatttttcttgttcccaaggttttttattatcaataatgagttgaataacaagtttttgttcttgtatgaatgataaacgtggcaaaataaatagaggttcaccattaaattgacagccgccgataagagataaattaaattgttgcacaaacgtttgtgctgatttaacttgcgtaaagcgacatatttctccaagccctaagatttttttattggtatcacgaaaattaagataaaattgcggataatgatgttgagcttttaaccaaccgagtaaattcaattcttcatctaaatccaaatgaaggacggaaaaatcgtttttagggtcaaattggtattgattaattaagcgaataaactcagccttaatctcgtgcaaattatccattttgtatcgtattaagttaaacattcagttaaaaacagctcttaattctaccgcactttaaaaaatttttttataaaatcttttcatctttttaaaataagcgtaaagtgtggctatattttgagtgacattattattaaaaggatagtttatgcgagttttccctaaatccgataagttagaacatgtatgctacgatattcgtggaccggtacatcaagaggcgttacgtttggaagaagaaggcaaaaagatcttaaaattaaatattggtaatccagcaccattcggttttgaagctcctgatgagattttggtagatattttgcgtaatttgcctgccgcacaaggatattgtgattcaaaaggtctatattctgcacgtaaagctattgttcaatattatcaatctaagaatattttaagtgcgaccgtaaatgatgtatacatcggtaatggtgtttctgaacttattactatgtcattacaagcattgttgaatgatggtgatgaggtgttaatcccaatgcctgattacccattatggacggctgctgcaacgttagccggcggaaaagcggttcattatttatgtgatgaacaagctgattggtttcctgatgtggcagatataaaaagtaaggttacttctcgcacaaaagccattgttattattaatcctaataatccaacgggagctgtttatagtaaagaattattattagatatagttgaagtagctcgccaaaatggattgatgattttcgccgatgaaatttacgataaaattttatatgacaacgctgttcatcatcatatcgccgcattagcaccagatttgttaacggttactttcaacggcttatcaaaatcttatcgtgtagcaggatttcgccaaggctggatgattttaaatggaccgaaacagcaagcgaaaggctatattgaaggtctagatatgttggcctcgatgcgtttatgtgccaatcatcctatgcaacatgctatacaaacagctttgggtgggtatcaaagtatcaatgaatttattttgccgggtgggcgtttattggaacaacggaacaaggcttatgagttgattaaccaaattccggggctaagttgtacaaagccaatgggagcactttatatgtttccgaaaattgatactaaaaaattcaatatctatgatgatgaaaaaatggtattggatttattgcgtcaagagaaagtgttattagttcatggacgtggttttaactggcaacaaccagatcattttagaattgtaaccttgccttatgtgaatcaaattgaagacgccttaggaagattagccaaatttttaacgcattatcgtcagtagttgtgaaacaagagagaacattttgctctctcttgttttgtcttttaaccttcttcacaaaaattttcaggtaaatttgtcagtattcctttccaaatagcactactacgttcacgattttcaacaagataaacactggcttgttgataatctccatttcgacaacattctttcaattgttgatagaaagtgagttcaacttggcgtgattgcggattaataaaaaaaagtgcggcgacttgatgataaagtgttctaaaactgtttaaaatcaaagtatatacgggcttatccgatataaagctaaaacgatgatagaggttatagtcaaattccgcataactcttttcatcatcatttaattcatctaaagattggaaaaattcaaacgtttgttgaggattaatttttattgcttcaggaataaattgttcacccattcgagtacgtaaagataccacatttgcaatgacggtaggtttaagagtaggtgataattgaatgagtgtttttaaaatgttgggaccagctgtttcccaaatattgtttactttggttggtttaccatgttgaatatttagccaaccatcacgattcaaacgctgtaatacttcacgtaatgttgttcttgttacaccgattttgcctgctagttcacgttctgcaggtaaatctgagccggcaggaaaatgattattccaaatgcttttgacaatatattcttcggctaacgcagccggactttgtgctttaagaatatccatacttctctttttgttaaacatactgtaataactaggtgggcattatccttgaaagcgatttatattacaatcatttaattatgttttttgctttcctttataagtgttttattctatattactcgtgcgtttgtatttttgtgttttgagtttttatgaaattaatttgatgacattaaggatcataggcatgctcatcttttttaaaaatttatcaatgaaacgtagtacttggatactgctgttcatttcagcattagtgttagaaagtagcgcactttattttcagcatggtatggggctgaatccttgtgtaatgtgtatttatgaacgtgtagctattttaggtatcctgttttcaggattgattggatttattgctcctagaggcttagttttgcgtatattagctttattaattggattagggagtacaataaaaggattattattagcaatcaaacacttagattatcaacttaacgtatacccttggaatcaatgtgcaatggttcctgattttcctcaaaccttaccattggataaatggtttcctaatatatttatgccttcaggttcttgcagtgatattacatggagttttttaggattttctatggtgcaatggattattgttatttttgcatgttatttcctatttttcattattctcagtataagccaatttaaaaaagtcagaaaaaacagaatgctgtttagatagctctgctcgttgaaatttttctcaaagtgcggtgttaaaatacattatttttgtaccgcacttatgttattaaaaaatcattctttaaagcttacttattcctaacgtgaacgcatctcctttagggggattagacgtagggaaaatcaagatttaataaatcttatagattattttgtgtctaagatctttagcaaaacgctttaacttacgtataaacggtacgttttcaactttccattctttgggcggattttcaagttgccggaataaatgacaaaataaattcgcttttagcattgaacatttttcatgccatgatttttttggaccaacataatgaataatagcaagaggcatagtcgcttcttcatattgattcagttcttttttacttaccctttttagtctatttaatgcattggcagtaaaattatatcttaagtctaaatattttacattattcgcaaaaatagcatttaaaatatcctgatcttgatacaaaaattcaatattattacgttcacaatattcaatccattgtaatgatttttcaaaaacatgacatttttcccattcaactacattaattaataatacgccggcattaaaataaaaatgtgtattaggtagatgaagttttgttttataatctgactgactgactgactgactgactgactgactgactgactgactgactgactgactgactgactgactgactggtcattcgtttgcttgtttttcgattttcaatccaagcatcataacaagctccgatcgccttgttttctaaatcagtattccacaaaggtaacaggctatgattgaccaatatatcaatatccaaataaataatttttgttaaattaaatttttttaaataatttaccagatttaatctagcgtaggttgataatgaaatatattctatagtttttggaaaattttcaaaatcacttatattaataggaacaatatttaagctacaattatttttattggctaattgagtgcaataatcctttgcaacattagatattcccatatccagtaaataaaaatgaatagtataaaattcattgtttttatctctggatttaataatactcaacattgttacggctaaatattttgcataattgtcatcacatgaaaagagaatattcatttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattttctttttaatctttttctaaatcgccctatttccttcgatatacttcgccataaantnttkyttgcttttttattattttctctctctctctctctctctctctctctctctctctctctctctgcacgctctactgaaataacgctggttaatttacagttttctttatttaaaataaaatcytgaataagaattgcaggatcwagytgataaacrggatattgytcttcttttaataatgattcaaataaaatgacatcaatwggmtmaattgaaatatygggagwttkaaataargyyaataattttytwgctgcaaattgygaaataatataycctgctgtwccccaatgtaraaamaktaaytgatgaaacctacgttgttggaaaggttgaattttagtactgcggtatattgattgcattgaatgagtttctaaacgaagaataaaatattgactaaaatcgaaccgctcttttaaccaatcatattgcccaagaaattggtgggcgactggactgagaataatgtcatcttcaaaaatagcgataaaaggtaaattttcatcaacacatttttgccataatagaacatggctcataaracagcctttttctcctattgtcagatcrgttttatttaargaagggacatattgttgaatrrtatkttcattttcttcattmggttgaaaagcatcaaaaaaggaatatggaatattttgyttgcyaaattctttttcaatatgttkacgtcgttcaatcgaactttttaarctaataacataattaaacattttgtttcctaaaaataaagtaacgtattctaacaatgatatgctatttgcagagatattattataagaattttacggcacgccaacctctcaatatcctttttctaaatcgccctatttccttcgatatacttcgccataaattcttgtttgcttttttattatttttactctctctctctctctctctctctctctctctctctctctcgggtgcaagagaactggttaatgtgcagttatctttatttaaaatacaatcctgaataataatggcaggctcacattgataaaccggatattgttcatcttttaataattgcttaaaaataatttgatctatttcttcaatgaaaatatccgtatttttaaataacgctaataattttttagctgcaacttgagaaagaatatagcctcccattccaaaatgtccagacattagccgattaaatttacggttttggtagtcgggaatttttgtcttgcaatattctgatttcatataaattgtttctaagcggagaataaaatattgattaaaagcgaaccgctcttttaaccaatcatattcactcaaaaatttattggcgaccgaactgagaaaaatatcatcttcaaaaatggcaataaacggtagattttcatccacacatttttgccataataaaacatgactcataaaacagctctttagtttatttgcgagactgcttttacttaaagctgggacatagtgttgaaggatattttcattttcttcattaagttgaaaagcatcaaaaaaagtatagggaatatgttgttggctaaattctttttcgatatgttgacgtcggtcgaccgcactttttagactaataacataattaaacatagtttactcattttttatatataaaatgtagtggtttgctactcaattaaattgacagtataaaaaataatttctaaaatagccaatattttgttgaagttactgtgaattatgttagataatgccaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcagcgatttttgtcataaatttagaaaaagcaactgaaagaaaacattttatttcccaccaatttaccgcacttcaagaacagcatcctgacatcgtaataaattatcagttttttaacggggtaaatggaaatactcaaccaaatcaccctttgtttgctaaatataatcaaaagaaacgttattatcgtaaaggaaatgaaattactttagggcaattaggttgttacgcaagtcattatttattatgggaaaaatgtgttcaattgcaacaacctattatcgtattggaagatgatgctattttacagcccaattttttagctgtttatcagttctgcttttctgcggaaaatcaatttgaatttttttggttaacgcactctaatagttcaaaaattagaacaaaattaattcacacgttacccgatagtacaaaattagaacaacattatttcggttatagtaacacgacaggttattatcttactcctcaagcagcacagaagtttttagactcttctcaagaatggatatataacgtagacatttttatggatcgtttttatgaaaatcatgttgctttattaggcgtaaatccgccttgtgtcaaacccgatttttctaagcaaagccagattacgatgaataaaaacaaccgcactttttgggttaagttaagacgtgaatattttgcacttcttgagcgtatcaagcgttttgtttattggacgttttattgttgatgatagatatggataaagtgctaggtttacgagcagacaaaattggaaacaaaataggcagggaaattattagaatttccagttcaaattgatctgacagtcagctgttaaacagagactgtcagattagttgctttttatccttgtttgtttagtaaaaagacgccattttcactaaaatgaacgtaggcctcgtgcatttcttgtgaaaaattctctgggttagcattgattagtaaatctttaccgccccaattagctatgatttcccaataacttcccatatagaccgcactttttattacacaacgttgttcttccataccttctgattttagtttgactgcctcaggacgaatacccactaaacattctccatcgttcaaagcgaatttatccgcatcaggtaaaacaaattgatagtcgttaatggtaattttgccttgttctaaatagccattaaaaatactactttctcccataaaacttgctaggaatagagagttaggatatttgtaaagctcttttgcgggtgccttttgcatgattttacctttattcatcacgatgacttcatcagataccgcaaaagcttctgtttgatcatgagttacatataaagaagtaatatttagacgctgttgtaattcacgaattttttcacgcattgaacggcgtaaattcgcatctaaattacttagaggttcatcaaataataacactttcggctttaatactaatgctcttgccagtgctactcgttgttgttgtccacctgaaatttgatcgacatagcgatcttcaaatcctgccaagtcaactaattctagtgcctcttttactctttgtttgcgttcatcagaacccacaccttgcatttttaagccatagccaacgttatcgccgatggacatatgcggaaacagtgcataagactggaatacgatacaaatatcacgattttggatggaagattttgttacatcttcaccatcaataaaaatttctccctcggttggactttcaagtcctgcgactaaacgcaataccgttgttttaccacaacctgacggccctaataaagttaccattgaaccacgttttatgttcaagtttaaattatctattactacggatttaccaaacgatttggtgatatttttgagtactaaaaaatcattattcatatttatagcctattgttaaaattttttatttttctaccgcacttcgttattcaagtgcggtaccgattaattcatttttttcgcttttgaacgggaaatgcgagtgtcaccaacgatccagtcgaagaataaaataattgccatcatcacaacaattaaaattgaaccataagcaatggctatgccatattcgccatcttcaactcgattcaaaatataggcagtagctactcgtgtatccgctgtaactaaaaaaacaatcgcactgacggttgtcattgctctaacaaagctggtaaccagtgcggaaagcaatgccggttttaataatggaaaaacaataaataaaatagtttttaatgaactgccttttaaagaaagtgaagcttcatctagagatttatctaattgtccaagtcctgcaaccgccgctcgcataccaacgggcatgttacgcattaccattgaaagaataataattagccccgtacctgtaaggtaaatcggtgcatcattgaatgcaatgatataagaaacaccggcaacggtacctggtacagcaaagcaaagtaaggttaagaattctaaggtttttttgcctttaaaatctcgtcttactgtaatatatgcgatgagcaatccgaaaatagccgtaattggagccgcacttatcgcaaaaataaccgtttgaattaatgacggccaagcaccatcactgaagccttgaccaaataacgttatgtaattttgtagagtgaacgtgtaatcaactccccagttttttgtaaagctaccataaaaaatactgccatataagaccgcattaaagaggatccaaaaacctaacgtaaagacaacgatatattttaaggtcgttggtaattcttgtacgtctcctcgataggattttcccgatactgttacataagaacgattacctatccaccaatattgaataataaatattgcgagagaaaatatgagtaatatcgtacctaacgtgctggctgaagcataatccaattgagaacccgcaatgtaaaaataaatttgtgatgaaatcacatcaaagctaccgccaagaactaatggcgtactaaaatccgccaatgattgaattgccacaactaagaatgaatttgctaatgctggctttaacaacggaaaaataatattaaaaaacgtttgatagcgatttgctcttaatgtataagatgcctcttcaatagatggatggatagattttagtgcaccttctaaaatcataaatgacatgggagtaagtgctaaagtatgagcaattacaatacctgtaaaaccatatagccagttactgctaaacccaaaatactcaactaaaaatgaagttacataaccggaacgaccaagcattaatgttaccccaagaccgactacaaaaggtggcgtaacgataggtaaaatagagaatattttgcctattaccgctgttcgcttagcaactctggtagtataaagtgcgaaaattaacccaaataatgtcgctagagttccaattgtaaatgcaaccgctaatgagtttccaatgatgcgtaaaacatagggtttactcacaatgtccaacacttggctaggtacaaatgtcgagccatcgtagaacatagaaaggaaaatggcgaaagttggataaacaataaagaaaaatataagtaaaatgatacttattagagaaaatataatgaacttatctccttgcataaatttcatttttgccaatgcgttggttgctaatgcaaccaacgtaataaccaagataaaaatggaatatccaagactgaacttttgcaaaatagcagacaaaaatacaaaaaagaagattcctacaacagcaaaaaattcaacttttccttgtttttgttccccgctatgttgaaataaatgagaaagtattggcacaatgagtaatgaaccaaaccaaagccaacttaaattaaacttagtccatcccattgcgtcataaatttcttcagatgtagaatctgttataccatagtgtaatgtcatagttggtaacacaaaaaatccaataaacgacaataaaatccatcctaggctacctttgaatattcgtgtctgttcactcataaaacctccgtgaaacaaaaattactttgctaatttaacttctgtaacccatttatcaataatcttgctgcgaacttcatttgatccaaatcgatcaaaatcataatcgattaagtttaattccgttggcttaagtgaataaggcgatggttcagcattagcattagttggaatatgatgggattgtgccttttgccaagaaagttcttgagcttcttttgacattacccagtcagcaaataattttgcatttttcaaattacgtgcatttttaatgatactgattccgcccagttcatagcccgttccttcacaaggaacaacaagctcaataggtgctccatttgctttttcaaaagagtaattttgtaaaaagcctacacctattgctgtttctcctcttgctgtatttcttgaaggagctgtacctgctttagggtattgggatacatttcgatgaagttttttcaagtaattaaacgccgcatcttctccccataattggataaatgttgcaattgccgtgtaagcagtacctgaactttgaggatcagctaattgaatttcgttttttagccgtggatctaagagatctttccaacattttggaacttcagtaatacctaatttttttaacctttcggtatttacaccaaagcctaatactcccatgtatacaacagaactctttccatttcctaatttttgaaattgaggaagcacttctgccaatttcggtgatgtgtaaggttcaatcagacctagttctaccgcttgtaagtgcgtgtcgaatggaccgccaaaccacacatcggcttgaggattatttttctctgctaacatttttgctaaagtgctacctgaactattgcgaataaatgatgcagtaacattgtatttttcagaaaaaccttgaacagctttttcgcagactatattttgagcactacaataaaccactactctccctgccgattttgccaaggtttgagcgtgaaataaacttgcaaaaaataaagcggaaagagataaagcaaattttgataacttcatacttattctcctaagtaaaaaatatttttatttagccaatttaacttcattaatccattttgtaattaaacgtttacgttctgcaacgtcaccatatttttcaaaattgtaattaataagttttaatttcttaggatcaaaagctaccggtgattgttctgctgtcgtgttagttaatgtttggaatgattttccttttttccaagctaattcttgcccttcttttgataacgcccaatcaacaaacaatttagcattttctaagtttcttgcacctttaataatactgacacctcctaattcataccctgttccttcacaaggtataatcatttctatcggtgcaccttgttgtttttgcaatgcataatcatgtaagaaacctattcccacagctgtttcaccacgagcggtattattagagggggtaattcccgattttgtgtactgtgaaatatttgggtgtaactgtttaaaataatcaaaagctttatcttctccccaaatttgaataaaagttgcaatcgctgtataggcagtccctgaactttgtgggtcagcgatttggatttctcccttaagacgaggatcggttaagtctttccagcattttggaatttcagtaatacctaactttttcaatcgttccgtgttcacaccataacctaaaatccccatataaatggcagaagtataattacctttcactttagccggatcttggaagcgttctacaatatgatcaatattggctgaacgatatggcgttaataatcccatttcagctgcttgtgcttgaggatcaaacgtacctccataccatacatcggcttgaggattatttttttcagcttcaatttttgctaaagtactgcccgaaccattgcgaatgaaagaggtttttacattatatttctcaccaaaagctttggtttcagcttcacacatctcattggttgcactgcagtagacaactaaacgcccctttgcattaacttgagtcgttaccattaatcctgttgcaaaaagtgcggttgatattgcccaagatatttttttcattttcatatggttctccttgtttgaaaaatacctgttgtaagacagtgtaggaatgataacacaagaaaaaataggatcatgtgaggaaagtcacacaatacaaaataaaagggagtgatacataaatcttctgagaatgactgtcaatacaggtaaattttctttataatcggcataaattttcgtttaaagtaggtggaatattatccatgtcagatcagtcttgtattattattgccattgctggtgcgtcagcatcggggaaaagtttaattgcatcgactattcatgaggaattgtgtaatgaattaggctgtgaggaaattgggattgtgacggaagacagttattacaaagaccaaacgcatctttcttttgaggaacgtattaaaacaaattatgatcatccaaattcaatggatcgtgatttactaattcaacatttatgcgatctaaaaaagggtaaagccgttgatattccagtttatagctatgttgaacatacaagaacccaagaagtaactcggtttgagcctaaaaaagtaattattttggaggggatcttgttattaacagatgagcgtattcgtcaggaggtaaatatgtcggtttttgttgatacacctttggatatttgctttattcgccgtttacaacgtgatatggaagaacgtggtcgctcattacagtctgtcattgatcaatataaatccacggttcgtccaatgttcttacaatttattgagccatcaaaacaatatgctgatatagttgttcctcgtggtggcaagaatcgagttgcgattaatatgttaaaagtgcaaattcaacatttgttaaataacaaataaggaacaaatatgagattatgtgatacagatattgagcgatatttggatcaaggtattatttctttaacacctagaccgagcaacgaaaaaattaatggtgcaactattgatgttcgtttgggaaattcttttcgtgtttttcgtgaacatactgcacctttcattgatttaagcggtcctaaagaagaggtaaccgctcaacttgatgcggtaatgagtgatgaaattattattggagagaatgaagctttctttttacatccgggtgaattagccttagccacaacattagaagcagtcaaattacctgccaatattattggttggttagatgggcgatcttcgctggctcgtttagggttaatggttcatgttaccgcacatcgtatcgatccaggttgggagggaaaaattgtcttagagttttttaattctggaaaattgcctttggcgttacgtcccaacatggtgattggtgcattaagttttgaagtattaagtggtactgctgcgagaccttacacaagtcgcaaagacgcaaaatataaacatcagcaaagtgcggttgccagtcgtattagtgaggacaagtaagggtatatctgattatgtggaaaaaaatcttcttttttattaccgctctttttgtcggcatagcaattttcacgtatgtgcagattgaaaaaattcaatcaacgttagtcgcaagattaaatgctaaccaaatagcggttgacaacattactattgattttttccctacaaagataacgcttactaatctccaatattctaaacatccttctcacattaatattgacacggcaaatattgaaataagcgtattgaatttattagcgggtaatcttgctgtaaaaaatattgttctaaacaacatttcccactcatatccatctttcccagctgttcagtacttaacaatgatagggaaaattacacaacaaaatagcaacattttctttgataatgtgcagctggaactgcaatttgctcaccctgtttatttggataaaagaacatttaattttcatattattgaaggattttttaatcaaaatgagatggagactcctaaatttgaaggaaatatcgtcataaatcagcaacctgtgctcattaaagcggagatctatcaatcaaaaaacgaggaaaagggactaaagattttgtttaaagcttgggattgtgagcaatgtgcggcagagtttgaatataattcaactcgtgatctttcatcgctgtttacagaaggaactttgcaatttagcagtcataattttcccattgaatattggcttaaaatggcagatttagatccacttataacaggaaaagctgatattgttgcgagtggtgtagtaaaaaataatcggttacaaaaactggacatgccaattacggttaaacaaggatctctatccggcgttaatttgttggagttggcgagtgggattttacctatcaattacgatagagaaaatgcaccgagggatatggcttttgaacatcttcaactcaacgcaaattgggagaataacttattgtatttagaagatatatttattttgactgagaatattattattgagggcaagggaatttccgatcttgatcagatgcaatgtgatattaatttagttatgcgaccgaccaataaaaaatatcaaaatgtcagtttaactgtacatttctttgatcagtgcaatcgccctcagtatcaattgaaaatccgagcaaaagattatttaaagcaattactaaaaagaaaattttcccattaagtctcatgttaatcatgcagtcttgtactgtgctgaaaaaataaactcaattttaaaataaagtgatatttactatacactttctttcttacctttataaaattattgccaataaatatcttttcaagataaaaatctaaaaacaattaaaaattggaattaaataaatatttaattatatttaaaagcaaaaactcaaattaaaatgctgaaaatgacattgacttaaccataaaatttcctcattattgggtaagtaatttatgaggaaaaagttatgtttttattaaaaaagttcagtcatcttttagcaaaatacaccgcacttgttatcattgcattagcttgtgttactttttattccccaaatctttttacttgggtaaaaggtgatgcacaaattattgtactcggtctaataatgctatcaatgggcatgaccttaggtaaagaagactaccgtattcttgcaaaacgtccttttgatattttagtaggaactatcgcccaatatagtattatgccttttgttgcaatttctattgcacaactctttaatttgtctctagggttaactttgggtttagtgttggttggttgttgtcccggtggtgttgcttcaaatatcatgagctttctttgtaaaggcgatgtggcttactctgtgggtatgactactgtttctactattttagctccaataatgaccccacttttattgaattatttagtaggtgaaacggttgcaatggacggttgggcaatgtttaagtttatgttgttagtaacattggttcctgttggtattggctcaattatgaacataacgtttgaaaataaaaaatggtttcaagagttgcgtgaattaatgccgggtgttgcggttattaactttgcttttattgttggtggcgttgttgcggtacatggaaataaatttttagaatccggttttataatttttgtatgtattgttttccataatgttattgggtacatcttaggtttctttacagggcgtttatttggaatgagtacagctaaaaaacgcactttatctattgaagtaggagtacaaaatgctggtttggcaacaggattaagttcaacatttttcccaactaatgcggagtctgctattgcttgtgcagtatcttgcgtatggcattctatttcaggcacaattttagcaaatttatttttatggtgggataaacgcaaaaatacatcaactcaagagaacaatcctgctaaaaatttaatgaatagcacgaaataaaataataaaaatttatactgcacttgagtttgtaagctaatcaaggtaatgtatgcgagtttattttattattgttttatgaggttaatatgaaaatcattcttttgggggcacctggtgcaggcaaaggtactcaagcacaatttattacaaataagtttggcattcctcaaatttctaccggtgatatgctacgtgctgcaattaaagctggaagtgaattgggacaaaaggctaaaatcttaatggatatgggacaattggtacctgatgatttgattatttctttggtgaaagaacgtgtagcacaagaagattgcgagaaaggttttttacttgacggtttcccacgtacaattccacaagcagacgctttaaaatccgttggtatcagtattgattatgtattggaatttgatgtgccggatgaagttattgttgagcgtatgagtggtcgtcgtgttcaccctgcttctggacggacttatcacattgtttacaacccgccaaaagtggaagataaagatgatataaccggtgaagatttaattcttcgtgcagatgataaacctgaaactgttctagatcgtttaaaaatttatcataataccactaaacttttggttgattattatcaagctgaagctgcacaaggtaacacgaaatactttcgattagatggtacacaaaaagttgaagaagtgagtcaagaactggacaagatcttgagctaagtgcttaaatagttcagacctctatgactactcaatactgagaacatagaggtctgcttttattcattgaatataaatatgctaattattgtgcaaccattaccatggcaggtctgataactcgcccatttaatagatagcctttttgtaaaaccactgtaatttgattactttcaaatccttctgttggttgcatggaaatagcttggtgtaattcagggttaaaagtttcgccaattacaccgacaggttcaacaccgaagcgtgcaacagttgataaaagtccttttaaagttaactcaacaccatcgactaaacttttgatggtttcattttctacattagcaggagtagacagtgcacgttctagattgtctatcgtttccaacaaatctttagcaaatttctctaaagcaaatttatgtgctttttcaacatcttgttcagcacgacggcgtatattatcaatttcagcacgtgtgcgtaacaaaatatcttgttctttttttacagcttgaataagctgttcttccagttcttgcacacgagcaatagcattttccaacgcatctccatcctgtatttcggtttcttccattggtttttcttgctcattttgagtttcaagttcagctgaaatttcctcttgttcgactttttcttgttctgacattatttttttactccattgttagatttgtatcattgtatcaaaaaacatagaaattaacacccgcacttattggcaagtagagtagaatgtgtgtaatatagtactccttttatttaattcaagtgttctttgtagaaagaccatgacaccagcaaattttattgatagtaaaaaattaattatttcgtttaagacgattgccttagtaggacgccctcgtcatgatgtgaatttacaaatgcacaaaaatttatttcattggctttctgaacgtggttatcaagttttagttgaacgagaaattggtgaacgtttaggattgtcggtaaatcatttagcggatttagatgaaataggctgtttagcccatcttgccattgttattggtggtgatggtaacatgttaggacgggcgagagtcctagctaagtataatattccattaataggtattaatcgtggtaacttagggttcttaactgatattgatccgaaaaatgcttatgctcagttagaggcttgtttggaaagaggcgagttttttgttgaggagcgttttttacttgaagcaagtattgagcggaatggagaagttgttgcacaaagcaatgcaataaatgagacagttatttatccggctaaaattgctcatatgatagattttcatgtatatattaatgataaattcgcattttcgcagcgttcagatgggctgattatttccacaccaacaggttcaactgcgtattctttgtcagcaggaggtccaattttaactccgcagcttaatgctattgccttggtgtcaatgtttccacatacgttatcttctagacctttggttattgatgctgacagtaagatttcggtgcgttttgctgaatataatacatctcaattggaagttggatgtgatagtcaagtagcactttcttttacccctgatgacattgtacatatcacaaaaagccaagataaattacgcttgttacatctaaaaaattacaattattacaatgtattaagtacaaaattaggttggcttaaaaatttagcttaaaaaatttttataagtctatttactgtatataaaaacatatatataattgtatttatatacagtaaaggattcatgctatgttagttcaacttaccattaataactttgcgattgttcatcatcttgatattgaatttgcgaaaggtatgtcagttattaccggcgaaactggagccggaaaatctattgctattgatgcactcggactttgtttagggcaaagaacagagttatctatgttacgtgacggacaagagagagtggatgtttgtgccacatttcatattgagagcattaatcctgcttatcaatggctacaagagcaggagttacaagattctgacaaccctgaatattgcattttacgtcgaattattaattctgatggacggtcgaaggcttttattaatggtgttgcagtatcagcctcacaactcaaaactattggacaatatctgattcagattaatggtcaacatgcttctcaacaattgctaaaaagtgactaccagattcatattattgatcaattttgtggacatgaggacttattgaaaaatatgcaagaaagttaccgcacttggcgagagttacaggaaaaagtaacgacatttcatcagaaatgtgctgaaaatgaagcaaaaaaacagctattagaatatcaagtagaagagttagatcagtttaatttgaaagaaaatgagtatttggagttggaagaagagcatactcgcttatcaaatagtgaagaattgatttctttatctcagtcaacattacagttattaagtgaaaatgagagtgtgagtattgatagcctgctttataaagcaacacaatatattgatgagctttgtcaattggattctaattattctgatgtgcaaacaatgttgcaagaggcacttattcaaattcaggaagccacgtctgaaatgcaacatttatcctcaaatattgatcaggatccaaaactgttacaggctgttgaacagcgtatgggacaagtgttacaactcgctcgtaagcataatgtgaaaccacaggatttagttgaattacataaacaactgaaaaatgaacttgagcaactcgttcacttttctgaaagtgaatcgcaattgatacaacaagaagaacagatgcgacaacatgtgcaagaaattgcaacgaaacttagcttaagtcgtcagcaaggggcaataaaattatcaacacaagtgacacaatctattaaattacttgctatggaaaatgcggagttctcaattacttttgatgaggataaaaaacttacaagtaaaggttatgatcaactctgctttaatttgagagcaaatctaggtcaatcagtacaacctttaaataaggttgcttccggaggggagctttcacgtattgcattggctatacaggttttaacctctgataaagcagctgttcctactttaatttttgacgaaattgatgtgggaattagtggtgctacagccagtgttgtgggtaaattattgcgacaattgggtgaaaaatgccaagtcatttgtgtaacgcatttacctcaagtagcttgctgtggacataatcattttgctgtagaaaaacaggttatagaaaataaaacaataactaaaatgaccgcacttacatcagaacagagagttattgcattagcaaaacttttgggggggcaaggcattggtgaaatggcattagctaatgcacaagaaatgttggatttagtcaatataaattaaatttcatttcgtatatttcaccaaaacagattatattatatccgattttagatctgatctattaataacagactctagcctcagtacataaaaatgcttatgaagtaaatagctgatactgtttcacttatattaattctattgtctgaggtagagaaaaccatacagcacggacttcacatcgatgtttttaagtctgattttttaaccctatataacctcgtttttgcaaagttgcttctttggattttctgatcattgtttctattgtcgtgccttgaattaaaattgaaaagagaacaacgctgtaagtaataataataaataaatctcgcacattcataccgatattttctaaaaatgcactcgttgcaggaatagaaagtgccatggcaagagagagaccgcctcgtaagcctccccaagttaaaattcgtaaagtataaggattgtacacagttttcatacttaagaatttgaatgggatccatacgcttgcataacgacaaaacaaacataccggaatagcgattagacttaagatgatcgcttgtgaagtaaagttcaccaataacatcgcagagccaattaataagaataaaagtgaatttaagaaatgatcaatcatttcccaaaagtgatcaagatagtgttgactttgttctgaaaaaccggagtgtcttgtccagttggaaatcataattccggctacaaccattgccaaggcaccagaaatatgaagcaaatttgctaacataaagccagcagtaggaatggttaaagtgagtaagatttctaaacttccgtcatcggtagctgaaatcagaaaatgagcaataacacctaagattaagccaaagaaaattccaccaacggcttcagctaagaagagttttgtaatctccattgcagttggctcatgtccaccaaatgcaacggtaaaaatagttgtaaaaataactaatcctacaccatcattaaataaagattcaccttctactttcatggataatttttttggtgcttttaagtttttaatgatggccaatacagcgatagggtctgtcggagaaatgagagcaccaaataaaatacaataaataaaatctatatgcagttttaataaggcagatattccgtaaaataaaactccaataaagagagttgatgctatcgttgaaaacaaagctaatattgtgatctccaatttttggctttttaatacaggtaatttaattcccaatgcaccagcaaaaagtagaaatcccaagatgccatttaataggaaatctttaaaatcaatgcgttgcataacgttttgagcaatgtcgtctaaatggaataaattagtggatcctgcgattagtaatatcagtgaacctacagttgctgttgcggtgattgcaattgtgtattgaatacggtcactgattttttgagtgacaaaaccgattaaaatcgatatggtagagagaaaacaaatgtaagtataaatactcataagaagtaccttctaaaatttaaaaatctgtttatattttattaattaatcaaattagtaaaatataaacagacttgacttgttctaattgagatagtcaagtagcgattgagcattagaaagttaataaaatgtaacaagaaaaatttttgcctagtataagtaaagtcctactttttataaagttcatttttataaaataattagaaatagttaatttatagcgttattttcgaccgcacttttgatatgaaaatgcttgtttaaggatagtaatggcagaataaattttgtttgttctgccattatatgttgaagaatgaaaaattaacattttgccacaataacaatttccactttccatttcgggtcagccaattgactttgcactgtggctctggtcggtgcattatgagaatcaacccattcatcccatgccttattcatttcttgatagtcttgcatatcagctaaaaaaatttgtgcattgagtatgttgcttttatcggaaccgatttctagtaataatttatcaattagacctaatacttcttttgtttgtaaataggcatctacattagtattttccggtacttgtccggcaaaataagcagtattattgtgaatcgttatttcagatagccgtccgttagaatgaaagcgttgtattttttccataatgtctccttagtgaataatgaaattatgtataaagattatagcgatttttgtaaaaatggactaggatctgcaagtttttcttgaattattgtagtggaaaattttgtgtgaaaatgctgatttctaaccaacatggtgcaactttaatggcattaatgccatttttatatggtatgcttttggctaaaccgacttggcagcattcctttttatttttggcttggtttagtctatatttaatgagctatcctttttttcatttgttcaaaggtaaaaaatcgaattttataaaatatcaaaaatacacattgatttatggcacgacaagtttgatatttgcactacctgttttttactacaattggcacattttatattttcttatcgcaatgttaccttttggcttcatcaatatttattttgtaaaacaaaaaaatgagcgagcattaattaatgatttggcggggataattatctttgctattgccggtatggcaagctattatttttctacttttacctttactcaacaaatttggttagttgctttattgccaagtttgtatttcatcggcactactttgtatgtcaaatcttgtttgcgtgaacgaaaaaatcctaagtatttattggcttcttacttgtggcatgttgcttgtgttgttctttttgttgcaatacaacagttttatcttgcatttgcttttgttataccagcaatacgtgcctattttttaccgaagatgaagatctcagctaaacaactcggtttaattgagattgcggtagcccttgtattttttattcaacttctttttgccactttatagagaagaggactactatgaaattactaatgttatgtcgagaacctcgcctttacagttgtcagcgtttaaaagaaagtgcggaagataatgggcatcagatagatattctggatcctaatcgttgcttattaaaactctcgaaaaatgcaccgcactttgagttgtattatcaagtgaatagtaaaagcgagccgtatttattaccggattatgatgcgattattcctcgttttggttctacaagcacaagaatggggtgtgccgtgttacgacattttcgtacaaaaaatgtattttgtttaaatgatgatgttgcgtttttaaaagccagagataaatggcttagtttacagttattgactgaacaaggtattgctgtccctaattcagcattgtcaggtgcagaattttctgccactcaagccattttgcaaattcaatcgccgacgattttgaaaacgttacacggttcacaaggaataggcgttattttggcagaaaatcgtaaaagtgcggtgagtattatggaaactttaactcaagcagacgtaccgttattaatgcaggattttattcaggaagcacaaggaacggatattcgttgttttgttattggtgataaagttgttgctacaatgcaacgtattggacaagaagatgaatttcgtgccaattttcatcgagggggaagtgcagagaaaattcagttaaccgaacaagaaaaagtactggctttaaaagcaacgaaatgtttagggctagatgttgcaggtgtcgatttgatccgttctaaacaagggttgttagtgctagaagtcaatgccagtcccggattggaaatgatcgaaaaaaccagtggaattgatattgccttgcaaatgatagttcacattgaaaagcagtttaagagataatgttttactcgtagtgcggtagaaaaataccttgttttttgttttaataatgaaatttaaaaaatcccgatatttacaaaggattcacaccttaacatactgaataaataggttaattatgttcttttggtatcaaaatcacgttatagctaagttacttgtttggctgttattcccattttctttggtcttttggtttatttctgttattcgtcggagattatttcgattaaactggctgaaatcctaccgctctcctgttcctgttttgattgtgggtaacttatctgtggggggaaatggaaaaacacctgcaacgatttggttggtaaaacaatttcagtcgataggtattaaagttggcgttatttcacgtggatacggtagtcgagcagagcattatccatatttagttaaaattgatgataatccaactcgttccggtgatgaacctttgttaatcgcacaacgcacaggcgtacctgtttgtatttccccgaatagacaacaagcaattgagcttttactggcacagtttaattgtgatttaatcattagtgatgatgggttacaacattataaattacaacgtgattttgaaattgtagtgattgatggcgaaagggtatttggcaatggttttgttatgccggcaggacctttaagagaattaccaaatcgtttagcggaagtggatttaattattaataatggaaagctaacaggttatagtaatacgttaatgctcttattacctaaattcgccgttaatttagtcagtggtgagaaaaaactattacgtgattttcaacgtattcctctcaatgcaatagcaggtattggttatccccaacgtttttttaatatgttacgagattttgcgttaactcttgaaaaaacgcaaagttttcaagaccatcaggattttgatgcagcacatttcgcatatttctcttcaaatcaaccgctctttatgacggaaaaagatgcggttaaatgtcgtccttttgcacaggcgaattggtggtatgtgccggttgaggctgatattcagggagaagaggtagaacgatttatgcaagttgtttcacaacaaataaaggagaaaaaatgaacggaagattattagaaattgtcgcatgtccaatttgccaagggcgattgaaatacgacagtgaaaatgagcaacttatttgtcaccttgatcatattgcttaccctattaaacaaggtattccaattttactttccgatcaggccataagtttgtctacatctttaaccaatcctgagcaacaaaatcagtaataaggagaatattcatgaatttcacggttattattcccgcacgttatgcgtccagtcgcttaccgggtaaacctttggctgacattgctggaaaaccaatgatccaacacgtttgggaaaaagcacaacaatccggtgcaacaagagtagtcgttgcaacagattatgaggaagttgcacgagcagttcgtggttttgatggagaagtttgtatgacttcctctcagcataattcaggtacagaacgtttggcggaagtgatagaaaaattagctatacctgatgatgaaattattgtgaatattcaaggtgatgagcctcttgttccccctgttattgtgagtcaagttgcacaaaatctacaaaaatatcaagtgaatatggcaactcttgcagtaaaaattgaagatgtggaagagttatttaatccaaatgtagtgaaagttttaacagataaagatggttatgttttatatttttctcgtgcagttattccatgggatcgggatcagtttgttcaactgggtaaagcagatttatctcaattgcaattgcaccaacattatttccgtcatattggtatttatgcttatcgtgccggctttattaaacaatatgtacaatggcaacccacaacattggaacaaattgaaagacttgaacaattgcgtgtcctttggaacggtgaaagaattcatgtggaattagcaaaacaagcgcctgccgttggggtagatacggtagaagatttagaaaaagtgcggtctattttatctcatgtttgatgccaaaaactttcttgccaatgtcacgcaccagcccggtgtataccgaatgtttgatgaaaaagggcaggtgatttatgttggtaaggcaaaagatttgaaaaagcgtttatccagctattttcgcactaatttgaacagtaaaaaaacttccgcactggtttcgcatattcattcaatagaaacaacaatcaccgcttcagaaactgaagcattattgcttgaacataattatattaaagcttttcagccccgttacaatgttttattacgtgatgataaatcctatccctatattctattaacgaaagaacgtcatcctagaattacctcgcatcgaggttcaaaaaaagtacaaggtgagtattttggcccttatccccatgcaggagcggtacgtgaaactctctctttgttgcaaaaattatttcctattcggcagtgtgaaaactcggtatataacaaccgctctcgcccttgtttgcagtatcaaattgggcgttgcagtggtccttgtattgatggtttagtatctgatgaagaatatcagcaacaggtcgattttgctcggctatttttacaaggtaaagatcagcaagtgttggagcatttgatcaaaaaaatggaacaagcgagtatgcaacttaattttgagcaggcagcttatttccgtgatcaaattcaggcgattcgtgcggtaattgaaaaacaatttgtttctaacgaacgtttagatgatatggatattctggcaattgcttatcagcttggtattgcttgtgtacaagttttatttattcgtcagggaaaagtattaggtaatcgcagttattttcccaaagtgccggcaaatacggatttaagtgaattaaccgaaacgtttgtcggacagttttatttacaggggcatcaaggtcggattataccaagtaccattattgttgatcatgttttgaatgaaaaacatgaacttgaggttttattaacagaacaagctggacgtaaagtaaatattcaagataatgtgaaaggcaataaaagcaaatttttacatttggctcaaatgaatgcacaagccgcattagtaacacagcttaaacaagctaatttaatacaagagcgttatcaggcattacaagaacttttgtctttaactaccattaaacgtatggaatgttttgatatcagtcatactatgggagagcaaacaatagcttcttgcgttgtttttgatactgaaggaccgttgaaatcagattatcgtcgttttaacataagcggaattactgcaggcgatgattatgccgctatggagcaggctttgttgaaacgttatgatcgcccattagaaaatgagaaaattccagatattatttttattgatgggggaaaggggcaattaaaccgtgctttacaagtttttgcacaattaaatgtatcttgggataaaaataaaccgctcttaattggggtagcaaaaggggtagatcgtaaagcaggtttagagacgttaattattagtaaacaaaataaggaagtgaatttattgcctgatagccttgcccttcatcttattcaacatattcgtgatgaaagtcatcatcatgccattggcggtcatcgtaaaaaacgtcaacaggcttttactcaaagcggtctagaagccattgaaggtgttggagcaaaacgaagacaagctttattaaaatatttagggggcatgcaaggtgtaaaaaatgcgactttagcagaaatttcctccgttccgggcatttctgctgcgttggcggaacggatttatgaaacgctaagaagtgaataagcagtaacaaagcaaaaggggaaaatatttaatttccccttgttttatctataaaatcagcaaaatcaaagaatgatgtttccattatcatctgccggttttgttagcccgataataaattcaatgagtgcgataaaaccgggaatgaaagtccaacagaataaaagatataaaatacctaatcccgttttaccggcataaaatttatgaatacccaatccacccaagaaaaatgccagtaagcaataagcaattttatttaccggtttggctgtttgagcataggtgttttttgtttttaaaataacaggtgcttcatcagtaccgaatacatcgacttcatctctgacctgtggttcaaaatccaatgctgttcttggtacttctttgatagaaccatcaggcataccaatagaaactatgccattttcgatttttatgattttagccataacgttccctcttagtgttattagttttaattaattaaaatttttaaaagccaaggaagaaaaagctgaataagagaattttttcattggcttaaaagtgcggtttattgtactcaacctggaattagttagcaatatttccaataatgcttctcgtttcttctttaacgtctacaagttgaacatgaattatatcgccaattttgtatgttttttctcctttaatataaagtgcaatttcctcggcattgacctgaagttcttctctattgctgtgtaaggttgatgccggaataaagacggaagcaccattttccaatagaagtacacgtaatccgccacgcatgacatcttgtatttctgcttgaaatatttgtttttgttctactttatctgctaaatagcgacaatataaccaatctgcaatatctcgctcaactaaacggttttgacgacgagcctcttgtaaacgttgtaagacactatcttgagggcgttcatattgttgtgttgtgagacttgctttaattaggcgatgattaactatatccgaatatttacgaattggagatgtccatgtggcgtaaccttgcaaacctaagccaaagtgcggtgctaattccgttttaaattctgctgaggttaagaaacgacgtaaacgcaattcaagataattattttcgcttgctccaatatcatgacgcatattgcagtatccacttaaggttgctaaattttctacagaatagcgttgtttcaattctgcttgattttgttcgttggttaaatttgacagcaggaaatgatgtgcattttccaagaattttttatcgaaaccactatgagtattaaaaatcccaaaaccaattttttcattcagatattgtgccgcacaaatattcgcaataatcattgcttcttcaacaatttggtttgcaatgcgacgatattctgttttaatctcttgtactttaccattttctgccagtacaaaagagtagtccggtttttctgtaaacagtaaagcatgagttttacgccattgtgatctggctaaggtaaactcatgtaaccacgcaatttgttgttgagtaacaggatcttgtggttgccaacagcctgttttttgttctaaataatcagacactttatcataagctagtttagctttcgacattacataagcagagacaaagtatggtgtagcggtaatttcaccttgtaaatctgtggtgatataacaaaccaaagcggcacgttgaatattttcggaaagagaacacagatcgtcagatagttcacgaggtagcatcggaatattaaaccccggtaagtagttagtgaaacaacgttgtttagcatcttgttcaatttgtgaattaatatcaatataagctgtcggatcggcaatcgcaacgactaatttccaaccgacttgagcttcatttttgctaattggctcaatatataaagcatcatctatatcttttgttgtttcactatcaatagtgatgaagtgaagtgcggtgagatcttcacgttcttgttgatccaatagagggtaactttcttgcccttgcacgggataacgagattgttcatgatatgccaaagttacccaccaaggtgcaagttcgtcatcagcgtgacaaataaattcagaaatgtgtgcaaagaaaaaacgatcatcacgtaaaggatggttttttagctgtgccacaacccaatctccctcttgtaattcttctttaacggcttttgttggtgtcgctccaattagctgattaatttgggggtgatcgactacaagttgtaatttcttgtctttattgaaccgcactttggcaataaagcgagttagcatgggttcaatgagttcttccggttcagcttgttctttatcgccaatcgtttcaatcactgctttaattttgtcgccatgcataacttttttcattgccattggcggaataaaataactttttttatcacactcaaggaaaccgaaggctttgtcagaacctcttacaataccttctacatgcggtttactatcacgaatttgttgtttgagttgggaaagtaggggattattttgaaacatattcttacgctataaatgaaaacggatgttcagttgaacatccctagaaaagattaaatgtagattattctgcacctaagtcgcccatggcagtaatgctaaaaccggcatcaacatgcaatacttcacctgttatacctgaagccaattctgagcataagaatgcggctgaattgcctacatcttcaatagttacggtacgacgtagaggggctgtgttttcaaaagtggccagcattttcttgaagtttttaatgcctgatgccgctaaagtgcggattggaccggctgaaatagcattgacacgaataccgtctttacctaagtctgccgccataacacgagttgccgcttcaagagaggctttagctaaacacatcacattatagtttggaatggcacgttcagaacctaaataagtcaacgttaataagctggcgttttgatttaacattggacgggctgcttgtgccattgcaacgaaactgtatgcactaatatcatgtgcaatgcgatagccttcacgagttgccgcattgacatagtcgccgtcaagctgatcacccggagcaaaagcaatagcatgcacaaaaccatcaaacttgtcccaatgctgttttaattgtgaaaaacatgccttgatgctttcatctgttgcaacatccaaaggtaaaacaatagtagaaccaaattcttgggcaaattcttctacgcgtgcttttaatttatcgtttaaataagtgaacgctaattcagctccttcacgtttcattgccgttgcaataccataagcaatagaacggttgctcgccaaaccagtgattaaaatgcgtttacctgctaaaaatcccataataaaaccctttattcggttagttaaaaagtcggcatagtataagtcaaaatgagagaaaaaacaaaagacgcaagagtacgctgatctttaagctggattatcaatatctttaaattcaacttcaaaaccgtattcttgagctagccattcgcctaaggcctgaataccataacgctccgttgcgtgatgaccggcggcaaaaaaatgaatgccttgttctctggctgaatggatcgtttgttccgatacttcaccggtaataaaagcatctaatccttttgttgcagccaaatcaatataaccttgcccgccgccggtacaaataccgacagttcggattaagtgcggtgcattttcgccacaaaataaaggtttacgccctaatactttttcaatgcgttgagcaaattcttcaccactaaccgtttcaattaaatcaccataaacaggaatactgaaactaccgttttctaatgggcgtaaattttcaatacctaataatttcgcaagttgtgtattgttacccaactctgcgtgtgtatctaacggtagatgatacccatacatattgatgtcattttgcaacaaggttttaatgcgtttacctttcatccctcggatgcaaggattttcatttttccagaaatagccatgatgaaccaaaattgcatcagcttgttgtgcaacggcataatcaattaacgcctggcttgcggttacaccggtaataattttttgcacattggattttccttcaatttgtaaaccgttgggtgcataatcggagatattggcactattgagtttttggttgataagttgctccagttcaagattattcatattgttatccatccaattaaattttatttaatttcagttccttttaataacttacgtatccaactgcgatttgggctgagattatgtagaatatcttcgctcaaagggagtggttctgcataaatcagagaggcaagggtttcacctaataaagcggctgaagttaaccctcttgaacctaacgcaccgatgagatataaatttttccattgtgctgcatcaggaataggctgtttacgacgacgtaaattgaagatgtttcggtagtctaaacattgttgctcaaaatgaggtacattccccataatcggcacacgatcacgcactgaacaacgaacacctattctagctatattggctgatatatcaatatcctgcaaccaatccatgtttttatccgtatcggtagaagctagattttgttgaattttttgctgattttcccgttgttcttgatggctaaaatggcgatctttgttattgcgaatatgacttgcaccaaggcaatgactctgtttcattttatccgccggagttaaatagccatcgtaacaaagtacggatttaagtttcagtaaattttcactggtcggaatttggctaacctgacctcgtacgggataaagaggaagtttagctgtttgcacaaaatctgtaatttgataaccattggcgagtacaacaacttgatgattaaaggtttcattttgttcattggttaaaacccattgtaaatttcggtagtcaagtgcggtaattttttgtgaggttttgatctctaatccaagttgttgtaagtaagagaaagtattttgcacaaattgacgtggagcaagccaagctccctgcggaataaaacctcctgcacaatctaaaggaagccctattttttcacttaactgctctttatttaaattctgatacaagctttttgaccattgataagaagaaatttttgccaatttaaccgcacttttgtgatcgtaagcacaaagtgctacaccacaaaattcatgttcaaattctataccttgtttaattgcccactgcaattgttgtaaagcatagaaaaaggcatgaacataaaaacgaatgttgcgatcatcgtcatcacttaattggggataaaaagcaccttgtttgttaccggaggcattgagggcaagttgctcatcttcacaataaagagtgatttttgcccccctttttaatagtgaaagtgcggtgaaaagtgaagcgattccgcctccgataattgcaatgtcttcagaaagtaatgaggcgggctgacttaagtaccaaggggcttttgcattttgttgtggaatagcgtttttaataccacataaacattcccgctttttgccgtaaccttttcgtttttgtacttcgaatccggcagaaactaatccttttctgaccgcacttgcagcggtaaatgtggaaaatgttccttgtggcttgctgtaatagaacatctgttgatagagttcatcattccacatttgtggatttttactgggtgagaaaccatctaaaaaccaagcatcaatacgattttgcatataatcacccagttggggcaaattatcggcaatatcaccaaaccataaatccaatgttgtttcagcaaaatgaaaacgttgacaaccttgtatcgcctctaagcaataatcgcataattgttgtgataaagcagaaaattgtgggtaaaattgatgaatttgttgtagttgaactttgggaagagggtatttctcaaaggaaataaaaaataaatgtttaagtggggaatgagaatattgttgccgaaattggcgaaataaacttgttacggcaagaaaatttaaacctgtaccaaatcctgtttctgcaatgacaaaatgtttttcttgatagacaatccagcgttcccataaatgattaccttgctgaaatacgtattcgctttctgctaaaccgtcttggttggaaaaataaacgtcattaaattgttctgataccggtgttttttcttgattcaggtaaattttggcgggtgtaactgtaaacataatatagctaatttttttgttgcattcatgatttttgctataatagcgaaaattttttcactggtcgaacattcgaagaaagacttgaaatattttcattttatagtaagttggcgaccgattattttattctttaacgtaaaggaatgtttctatgagaagagccgtggttacaggttttggtattatttctagtattggtaataataaacaagaagtgttagaagctttaaaaaaagggaaatcaggtattgaagtgatgccggattttgtcaagatgggcatgcgtagtcatatagcgggaacaattaaattaaaccctgctgaattaattgaacgcaaaattttccgttttatgggagatgctgctgcttatgcttatctctcaatgaaagaggccatcgaagatgctggattgacggaagatcaagtttccaatgatcgtaccggacttgtcatcggagcgggaacaggatccggtcataaccaaatggttgcttgtgatgctgtaagaggtccaagaggcgttaaagctattggaccttatgcagtaactaaaacgatggcatctagtgtatcggcttgcttagcaacaccttataaaatccgtggcgtgaattattcgattagttctgcttgtgctacttctgcacattgtattggacatgccgtagaattaattcaattaggtaagcaggatgtggtttttgccggcggagcggaagagttatcttgggaatgtgcaactgaatttgatgcaatgggagcggtttcaactaaatacaatgaaacgcctgagaaagcttcacgtgcttatgacgctcatcgtgacggatttgtgattgccggtggcggtgcggtagtcgttgttgaagaattagaacatgctttagctcgtggagctaaaatttatgcggaaatcgttggctatggtgctacatctgatggatacgatatggttgcaccgagtggtgaaggtgcggagcgttgtatgaagcaagcattggcaacagtggatacgccagtggattatattaatgtgcatggtacgtctacacctgtcggagatgtaaaagagttaggtgcaattcgcaacgtattttctgatcaaaaacctgccatttcttctacgaagtcaatgacggggcattcactaggtgcggcgggtgctcatgaagcgatttatagcttattaatgttagaacatgattttattgcacccagcattaatattgaaactttagatgaacaggcggtaggtatgaatattgtaactgaaacaaaagagaatgcgggactcgaaaccgtgatgtcgaatagttttggttttggtggaaccaatgcctgcttggttttcaagcgttataaaaaatagagataattcttttatagtgatctatctaatgatttagacagatactgttcttttagatcttattttaaagaactattttagatattgaagtgagctgcctctaaaagttggacggaataaccaactgattagaggcagatttttatgattaaatgcaaaacaacaaactactgagtagtctttttatatttttagaatttgttttatattaaaattctctctttatctttaaataaaaatttaataaatatcaagtttaatgaatataatttttaataattgttattttgataaatttaatttaatgatattatcttaatgctttaatatggaaggttaaatcctgaaaagcaaggtactgaatacgatgttgctattaagcgaacttttatacgcatgaaacaggtcgtggcgtcttttgattttttattttattgatgtggttattatgaaaaaatttattttactcggattattactttctttttcttcatcaagcattgctgagttatctgattggattaagccgatttcggatatctcctccggagatactgcatgggtgatgatatctgcaatcttggttttatttatgactatccccggtttggcattattttatgggggaatggttcgtaaaaagaatgtgctgtcgacaatggcacaaagttttgcggtaagcggtttgatagccgttatttggttgtgttttggttatagtctttcatttacaccaaataatgcttttattggcggaatggatcgtttttttctgcaaggtttaaatgtgtttactgaacagaaaatgcttactgtttatccgggagctggaacgattccggaatctgtttttatgatttttcaaatgacctttgccattattgctggagcgatcattacaggtgcgactgtagagcgtatgaaattttcggcattattgttatttgttggattatggtcacttttgatttatgttcctaccgcacattgggtatggggaataggtggttggctagtaaatgatggggtattggattatgccggtggtaccgttattcatattaatgcaggtgtagcaggattagtcgctgcaattgtcattggtaaacgggtcggttacagacatgaagtgatgatgccgcacaatttagtattaactcttataggtacggcaatgttgcagattggttggtttgggtttaatgcgggttcggcacttgctgctgatgcaagagcgggtatggcattagcaactactcagatttcagcctcggtcggagcattaacttggatattagtcgaagtattttgtaaacacaagccgtctgcgttgggtttggcatcaggagcggtagcagggttggttggtattacgcccgctgctggttttgtatcggtacaaagtgctttattcataggtatgataacaagtgcggtctgttttgtcggtgtaatgaaactcaaatattggtttaggtatgatgatacgctcgatgcgtttggtattcacggtttaggcgggattgttggagcggtgttgacaggcatattcgtatctcctgatatttcagctaccgaaaccacactttggacacaaattgagagtgtactaattactatcatttttagtgcatcaggtagttttgttttattaaaaataattgacaaaaccgtagggttacgagtggagcgagatgaagaacgtcaaggtttggatttaagttgccatggtgaaagaatagaatagttaaaaaatgacagcactttacgctttataaagtgcggtcagattatagtagctatataatttgaagatgaaattcgaacacctattatttggcgttaattaaataatttttccctccagtatccaaattcttttaacaattgtgagtttatgttcaaagaaattgcttgtatttgtacttaaatcgtgaagttagtcgctgatggttgtagaaaaaataaaagttacattctaaaagaagatccaaaatttaaacacgcaatagatagttttgaatggacagcttagcctgtgggtaggggcttgccctcgttctctgttttttgttatcaacctattttcaggtaaatacagagaacccttctcgactagtttggatttaccgagtaatcaataagggaatatgtctgaaaaaatggttcatttcttaattgttagcatactattatcaagctgcatgagtactgctataaaattttaggataatttaggataataatgggggaactctctcaaaaagaagccaaaatttttgatcaatgtcaagagggggtaatcaattaaaaagtaataacagatttaaccattaacttttaatttacggagatatatgatgaacagcgtgaacaattcaattttttaacgaactaacccattcgtcaaatgtaatatcactcaaattaataattttgaaaaagatttttcaatcaaaagccctgaagattatagaaattatttatgctatttaataatagcggagctagtgttcatcatatgtatggattgcataattatgagacatgtagattttgaatggaaaaaggcatgttggagcatgaacagggaactttagatcggttattataatttggagcgggaaacgaggctcgaactcgcgaccccgaccttggcaaggtcgtgctctaccaactgagctattcccgcttattcctgaagaacggagcgtattatacaaatattttactaagaagcaaggttaaaatttaaaaaaacgcaaccttgcttgattattggttgaattaattatttggttgttaagttaataaaggtcttcctataatgagctaattcagcaatggattcacgaatatcatctaacgccaaatgtgtgttctttttttcaaagctatttagaatttcaggtttccatcttgatgcgagttcttttagtgtgcttacatctaaatgacgatagtgaaagtattcagctaattcaggcatgtagttgattaaaaaacgtttgtcttgagctacactgtttccacaaataggagaaacacctttaggaacccatttttttagaaaatccaaggtttgtaattctgcagcccgttctgttaatttgctgttttttacccgttcgattaagccgttagatgtatgagttttcacgcaccattcattcatgttattgagaagttcgtttgattgatgaatggctaaaacaggaccttcagctaaaatattgagatctttatctgttacaattgttgcgatttcaataatccgttctttatcaggatctaagcctgtcatttccaagtcaatccaaataagattttgtttatctaattgcataataagagtatcctatacaaaatttcttatattctaactgaaaaatgaccgcactttaaggatttctctttgagcaaacgtaaattaacccaaaatcaacaacgtcgaattcaatctaataatgcaaaaacattacatcgtcatcaacatcggcacaaatcagatattgattggcaagatgatatgcttggtgattttcaagatggaacggttgtgacaagatatgctgttcatgctgatgtagaaaatgaacaaggtgaaattgttcgttgtaatttacgccgtacattgaaaagtgtcgttgtgggcgatcgtgttgtttggcgtaaaggaaagacacaactacaaggtgtaagaggggtcattgaagcggttcaaccacgacataatcagattgtacgcccggattattatgatggtttaaagccgattgcggctaatattgatcgtattattattgtttcagcggtattaccaaatttatctctcaatattattgatcgttatttagttgtttgtgaaagctcgaatattccagccgttattgttgtaaataaagcagatttattgagtagtgaagctcgaatagaagttggcttacaactcgaaatttatcagaaaataggttatgaaacgttattaatctctgccaagagcggtgaaaatatggataagctaaccgcacttttgtctgagggaacgtctatttttgttgggcaatcaggtgtgggtaaatcaagtttaattaattatattttgcctgaagtgaatgcacaaactggtaagctcagtcaagtatctggtctaggtcagcataccacaacatcttctcgcctatatcacttatcacaaggaggaaatttgatagattctcccggtattagagagtttggtttgtggcatttagagcgagatcaaatcacgaacggttaccgagaatttcagtattttttgggaacttgtaagtttcgagactgtaaacatttgcatgatccggggtgtgctattcagcttgcagtgaaagaaggaaaaatcgatcctttacgttttgaaaattatcatagactaattacaagtttgtccgaaactaaatctcaacggcattttatatcggcgaattaagttaaagaagatattttgtatacttaataaacaacttggggctttttttgtgatgtagttcaaattttaatgtggtttaccttgattattctgatttgaaacttgatactatgcgtccgatttatttttttatttaaaataaatatgaactgacactaacgaattgtttttgaagcgttaggatactacatgtagaatgatttaaattaagaggatacagttatgtactcaaaagatgttgaaattactgcaccaaatggtttacacactcgtccagctgcacagtttgtaaaagaagccaaagcgttcgtttctgatattacagtaacttcagcgggcaaaagtgctagtgcaaagagtctatttaagttacaaaccttgggattgactcaaggtacagttattacgatttctgctgatggtgaagatgaacaaaaagcggttgaacacttagttgcattaattcctactctagaataatcaatatatttattagccataacttaatgttttcataaataataagtttatggctattgtgttatttagcgtattgtaatttaaaattattttggaaggttaatatgatttcaggtattacagcatcaccaggtattgtatttggtaaggcactggtgcttaaagaagaaaagattgttcttgatacgcaaaaaataaaagatgagcaaatagacattgaagttgctcgtttttatagcgggcgtgcggcagctatagagcaattgattgcgattaaagatcgtgctttagtctctttaggtgaggaaaaagctgcaatttttgaaggacatttaatgatccttgaagatgaagaactggaagaagaaattttagattacttacgttcaaataaggtcaatgcaggcgttgctgcaagtaagattattgatcaacaagttgctatgttgtctgaaattgacgatgaatacctacaagagcgtgccggagacattcgtgatattggtaatcgtttgattaaaaatattttaggtatgaaaatcgttgatttaggggatattaatgaagaggctattttggttgcttatgatttaaccccttctgaaacagcacaattaaatttggataaagtattaggcttcattacagacattggtgggcgaacatcacatacttctattatggctcgttctcttgaattgccagctattgtaggaaccaatgatatcacttcaaaagtcaataccggtgattatctcgttcttgatgcggttaataatgcgatttatgttaatccgacacaagaagaaattgagcgtttaaaagctttagaacgacaattagctgaagaaaaagcggaattagctaaattgaaagatttaccagcattgactttagacggacatcaagtagatgtggtagctaatattggcactattcgtgattgtgagggagctgatcgtaatggtgctgaaggtgttggattatatcggacagaattcttatttatggatcgtgatcagttgccaacagaagaagaacaatttattgcttataaagaagttgttgaagcaatgaatggtcgtttagttgtgttacgtacaatggatattggtggagataaagatttaccgtatttgaatttacctaaagaaatgaatcctttcttaggttggcgtgcgattcgaattggtatggatcgtcgtgaaattttacatgctcaattacgtgcagtattgcgtgcgtcagcttttggtaaattagctgttatgttcccgatgattatttctgttgaagaaattcgagaattgaaatctgtgattgaaagtttgaaacaggaattacgtgatgagggtaaggcttttgatgagaatcttcaagttggggtaatggttgaaacaccggcggcagcaataaatgcaaaatttttagcaaaagaagtcgatttttttagtatcgggacgaatgatttaacccaatatactttagcggttgatcgtgggaatgaattaatttcacatttatacaatccgatgacaccggctgtattaaacttaattaagcacgtgatagatgcatctcatgaggaaggtaaatggactggaatgtgcggtgagttagcaggcgatgaaaatgccacattgttattgttaggtatgggattagatgaatttagtatgagtgcaatttcgatacctcgtattaaaaaattgattcgcaatgtgaattatcaggatgctaaattacttgctgagcaagcattacagcaaccaactgcggcaggtattttgagcttagttaatgattttttagtggaaaaagcacttaattaatatcatttgataaaaaattacgctagaatagtgcaattattcatgagtaggagaaagtttaaatggctttttttgataaattatttggttcaaaggaaagcaaatctattgatgttgaaatttatgcacctatatcaggtacaattgtaaatattgaggatgtaccggatgtggttttctctgagaaaatagtaggtgatggcatagcaattcgtcctacggggaataagattgttgcacctgtagatggagtaatcggtagaatatttgaaactaaccatgcattttcaatagagtccaaagatggcgttgagttatttgttcactttggtattgatacagtagaattgaaaggtgaaggttttactcgtattgttcaggaaggtcaacaagtaaaacgtggtgaaacaattattgaatttgatttggcttcattggaagcaaaggcaaaatcagtattaactccgctggtaatttcaaatatggatgaaattaatagtatggataaaatgtctggcgaggtcgtggctggcgagtcagttgtactcttgttgaaaaaataatgaatagtgttatttaaaacggattggtagtggctaatccgtttttttatatcaataaatttttaaggaagaacagcatgtgttttttctattttcatataaaaactactatctttatttcaaaaaatctaataacatttacgaaatttgttaagatttgtggcgtaaactagatttgattagtttcgttgtgagttttgctaacattatcagaattttagttatcaatccgttgtttaatttagtgttataaattaaacgtaccttttaacttaacacaataaggaaaagactatgtcagatatattgaaaaatgacgtagatccggtcgaaaccaatgattggttattagcgatcgattcagtaattcgtgaagaaggtattgagcgtgctcaatatattatagaacaattgatgcaacatgcccgtgcaaattctgtgtcattaccaacgggtgtaagcacagattacattaacacaattcctccatcagaagagcctaattaccctggtaatttagacttggagcgtcgtattcgtagtgcaattcgttggaattcgataatgatggtattgcgtgcttcgaaaaaagatctggatttaggtggacatatgtcttctttccaatcttcagcaactatttatgaagtttgttttaaccatttctttaaagctcgtacagaaaaaaatggtggtgatttagtttttttccaaggtcatatttctccgggaatttatgcccgtgcattcttagaaggtcgtgtaacagaagagcaattagataatttccgtcaagaagttgaaggcaaagggttaccttcttatccacaccctaaattaatgcctgaattctggcaatttccaactgtatcaatgggacttggaccattgaatgcaatctatcaggcacgtttcttaaaatatttacataatcgtggcttgaaagacacttcagagcaaactgtttatgcgtttttgggcgatggtgagatggatgaagtagaatctcgtggtgcaattgcgtttgctgctcgtgagaaattagataacttagtttttgttatcaactgtaacttacaacgtttagacggtccggtaaccggtaacggtaaaatcattcaagaacttgaagctcaattcaatggttctggttgggaagttattaaagttatttggggacgccgttgggatcgtttattacaacgtgatacatcaggtaaattattacaattaatgatggaagttgttgatggcgattatcaaactttcaaatctaaagatggtgcttatgttcgtaaacacttctttggtcgttatcctgaaacagaagcattagttgcggaaatgacagacgatgaaatttttgcacttaatcgtggtggacatgatccattaaaagtatttgcagcatttaataaagcaaaacaagttaaagataaaccggttgtattgttggttaaaacgatcaaaggttatggcatgggagaagcagccgaaggtcgtaatatagctcatcaagtgaaaaaaatggatatgtcaggcgttaagcatgtacgagatcgtttcaatgttccggtatctgatgcagaaattgataacttaccttatgttaaatttgcagaaggaacagaagaatataaatatcttcatgaacgtcgtcaagcattgaacggttatttaccgactcgtttacctcgctttacacaacaaatggatgttcctgcattagaagaatttgcacaattatttgaagaacaaagtcgtcctatttccactacaatggcatttgttcgttcattgaatgtattactgaaaaataaatctgtaggtaaacatattgttccgattattgctgatgaagcccgcacttttggtatggaaggtttgttccgtcaaatcggtatttataacccacatggacaaaattatactccgcaagatcgtgaacaggtatcttactatcgtgaagcaattgatggacaagtattgcaagaaggtatcaatgaacaaggtgcaacagcatcttggttggctgcagcaacgtcatattcaacaaatgatatgccaatgattccattctttgtgtattattctatttttggtttccaacgtgtaggtgatttaatgtggttagcaggcgatcaacgtgctcgtgggttcatgattggtggtacttcgggacgtacaaccttaaatggtgagggattacaacatgaagatggtcatagccatattcaatcttctgttgttccaaattgtatttcttatgatccggcttttgcttacgaagttgctgttattatacaagatggcgtgcgtcgtatgtatgggcctgagcaagaagatgtgtattactatatcaccacactgaatgaaacttatgatcaacctgcaatgcctaaaggtgcagaagaaggtattcgtaaaggtatctataaatttgaaacagtaactggtcaaggcaaaggtaaggttcagttattaggttcagggtcaattttacgtcatgttcgtgaagcggctaaattacttgctgacgatttcggcgttacatctgatgtgtacagtgttacttcatttactgaacttgctcgtgatggtgcgaatgcggatcgttggaacttattacatccaaaagcagaagctaaagtaccttatattgctcaagtaatgaatgatgctccggcaattgcttcaacagattatgttaaactatttgcagaacaggttcgtccatatatacctgcacaaagttatcgtgtattaggtactgatggttttggtcgttcagatagtcgtgaaaatttacgtaaacatttcgaagtaaatgcacattatgttgttattgctgcgttaaccgagttggcacagcagggtactatcagcaaagatgtagttgctcaagcaattagtaaatatggtattgatgcagataaaatcaatcctttatatgcataatcaatatttgaactgagcggatataatccgctcataagaaaaggataagataaaatggctaaagaaattcaaattccagatattggtggagatgaagttactgttactgaagttatggttaaagctggagatactattatagttgatcaatctgtgattaacgttgaaggcgataaggcatcaatggaagttccatcaccggaagcgggtgtcattaaggaagtattagtaaaagtaggcgacaaagtttctactggaactcctatgtttgtattagagaatgcagaattagcatctaccgagacagcatctgaaagtatgcaaaccgaaaaaacacaaagtgcggtagcgtctatcattgaaatttatgtacctgacattggtggtgatgaagtcaatgtaactgatattatggtttctgtaggtgagacagttgcagaagagcagtctattttaaatgttgagggtgataaagcctcaatggaagtgcctgcccctactgccggtatagtaaaagaaattttaatcaaagtgggagataaagtgtcgaccggttctcttgtgatgaaatttgaagttgcaggtgttgtatttgtagccgaaacagctcaagtttcttcttcagctgaagtaacaggtgaaagtgcggtgcaagatgtacacgttcctgatatcggtggtgatgaagtcaatgtgacagaaattatggttgcagtgggcgatagtgttacagaggaacaatctttaattactgttgaaggtgataaagcttcaatggaagtgcctgctccttttgctggtgtagtgaaagaaattttggtgaaatcaggggataaagtttcaactggttcattaattatgcgttttgaagtgcaaggaaaagcccctattccagaagcatcatcggcggtgacagaggctaaagtggctccacctccagctgcacaagaaaatcaaatgacgccagtgtctcaagctgatgtgactgcaagtgcggtgtttgctcatgcaactccggttgttcgtcgtttagctagagagttcggcgtgaacttagacaaggtaaaaggaacgggtcgtaaaggtcgcatcttaaaagaagatgttcaggcttatgtaaaagcggcaattaaagcggttgaaagtggcaatgtttctcctacatcagcaggtaatggtgctgtcaatggagcaggactaggcttgttaccttggccgaaagtcgacttcagtaaatttggtgatattgagcaagttgagttgggtcgtattcagaaaatctccggtgcaaatttacatcgcaactgggtaatgattcctcatgttacgcaatgggataaagcagacattacggaactggaaaaattccgcaaagaacaaaatgtgttggcggaaaaacaaaaacttgatgtaaaaattacgccattagtatttattatgaaggccgttgctaaagcgttagagaattacccacgctttaatagttcattatcagaagatgctcaaagcctgattctgaaaaaatacattaatattggagtggcggttgatacacctaacggcttggttgtacctgtgtttaaagatgtgaataaaaaaggcattattgaattatctcgtgaattagcggaaatttctaagaaggctcgagctggtaaattaaccgcatcagatatgcaaggtggttgttttactatttcaagtctaggaggaattggcggtacacactttacgccaattgtaaatgctccggaagtcgcaattttgggcgtatctaaatctgaaatgacaccggtatggaatggcaaagattttactcctcgcttaatgcttccgttatctttgtcttatgatcatcgtgtaattgacggtgctgatggagcaagatttattactttcattaatagtgtattaagcgatcttcgtcgtttagttatgtaaatactacgcctctaaatcttattagggggcgttaaaactgttaaagtgcggttgaaaaccgccaacttttaacgaggtaaaaaatgaataaagagattaaaacacaagttgtcgtcttgggagcaggtccggctggttactcagcagctttccgttgtgcagatttaggcttagaaactgttattgtagagcgattttcgacgcttggtggagtatgtttaaatgtaggttgtattccgtctaaagcgttattgcatgtagctaaagtgattgaagaagctaagtccttatccgttcatggtattgtttttggtgaaccaacaacggatattgataaaattcgtggttggaaagaaaaagtaattaatcaattgactagcggtttagccggtatggctaaacagcgtaaagtacaggtagttaatggttatggtaaattctcaggaccaaatgcaattattgtggctggtgatgaaggtgaaacgaaaattacttttgataatgcaattattgctgccggctctcgccctattcagttaccatttattccacatgaagatcctcgtatttgggattctactgatgcgttaaagttaaaagaagtacctgaaaatctcttaattatggggggcggtatcatcggtcttgaaatgggaaccgtttatcatgctttaggttctaaaattgatgtggttgaaatgtttgatcaagttatccctgcagcggataaagatatggttcaaatttatactaaacgcattgaaaaaaaattcaatttattactggaaactaaagtaactgctgttgaagcaaaagaagacggtatttatgtatcaatggaaggtaaggctgcaactgaaactcgtcgttatgatgcagtattagttgcaattggtcgtgtaccaaatggtaaattaattgatgcaggtattgctggcgtcgaagttgatgatcgtggctttattcgcactgacaaacaaatgcgtactaatgtacctcatatctttgctattggtgatgttgttggtcagccaatgctagcacataaaggcgtacatgaaggtcatgtagctgcagaagtaattgcaggacaaaaacattattttgatccgaaagttattccatctattgcttataccgaaccggaagtagcttgggtggggaaaactgaaaaagaatgtaaagctgaagggattaattacgaagttgctaagttcccttgggcagcgtctggacgtgcaattgcatccgactgtgctgatggtatgacgaaattgattttcgataaagatacacatcgtgttattgggggagcaattgtcggtactaacggtggtgaattgctaggtgaaattggcttggcaattgaaatggggtgtgatgctgaagatttagcactaacaatccatgctcatccaactttacatgaatctgttgggctagccgctgaagtttttgaaggctctatcacagatttacctaacccaaaagcgaagaagaaaaaataataatctagctcgctgagacaataaggcgatcttttatgagatcgccttatttttttgcaaaaaagtgcggtaaaaaatacggcactttttaggcggcaaattttatttgattttcttttggttttatttgatggattgtgttggttacagtaccaataataggcaaagtttgccaattagatgttcttattgaatgtactttattatctagtgggaaaaaaataaattcattattttcatacatcatgaattcataaatttgaaattggttattaagatctaaaacgacaagatcattcattgaaaggtaattttgtttttctactataagaatatcacctggctcaatattccaagcgagcagattaggattgttaacttgaataaaacaagtttgttgtgggtgtttaatacagtaaagattgagatctagttttttgtgtgaacttctattacgttcctcaatatcaatgaagaatggcataggttggtaagaaagtgtagtgtttatattgctgatattctgatttgcgtaacccatctttttctccaatctaagtatgttatatgttaactgattatttatacaggtatatattactgtttttatatacatatggtcaatagaataatagaaatttttagaaatttgcagattaataaatgtattttattttataaaaattcaaaaaatgtttattttaatattttctttataatcaatttacgttatctttactaaaccttggtggatctatagatctgtatttttaactcaaaaaacacaacatttattattatgaataagtcatatttatactccttcttttttcatggaagtttggtcaagcgaatttctgttggtcttttattgggattgctgttagcattaatcgctccatcattgcaaggtgtattaggttttaatcttgcagaaaaagccggttttttaggaaaaatatttgtgcgttcattgcgtgcagttgctccaattttagtttttttattggttatttctgcaattgctaataagcaattaggcacaaaaagcaatatgaaatctattgttgtcttatatttgctaggaactttcttagctgcattgacatcagtattatttagttttgcattgccgacagaaattgctttaaaaacgcaagaaggctctctttctccgccaaacgaagtatctgaagttttaagtaccttagtactgaacgtggtagataatccaattaatgctttatttaatgcaaactttattggtatcttattttgggcaataggtttggggatagccttacgctatgcgtcagatacgactaaaaatgtcatgaatgatttttcagaggctgtatctagaattgttcattttattattagttttgcacctatcggtgtttttggtttggtggctgaaactttaactgataaaggtttaggtgcattgcttgattatatgcaattactagttgttttaattgggtctatgctatttactgcatttgttattaatccaattttagttttttggaaaattcgtcgtaatccatatcccctagtatggacttgtgtacgagaaagtggattaacggcattccttacacgtagttctgcagcaaacattcctgtaaatatggaattgtcaaaacgcttaaaattagatgaggaaacttattcagtttcaataccgttaggtgctaatatcaatatggcaggtgcggcgattactattacggtattaacattagctgctgtacataccttaggtattgaggtctctttccctacggctgtattgttaagtgtagtggctagtatttgtgcttgtggtgcttctggtgttgctggcggatcattattattgattccattagcttgtagtttatttggtattcctaatgatattgcagcacaagtaatcggcgtcggtttcgtcattggcgtattacaagattcaacggaaactgcattaaactcttcaacggatgttatttttacagctgcggtatgctggagtgaagaaaataaaaattcatagagtttatctaatgtgaaatatagcgggtatgggtacatatccgctttttcattatacttgatagccttctgcatgaagtgataaagtagaaaaaatttcatttacgatgagaatgctttagcatcactgtactttttgctttgaaatggagatatccctctcataaaaacactatagttttcataagaataagttattttcaaaatatactaataatccatatggttattaatttttacaaaaactttctgttcaataatttaaaaaagaggaatataataggatacactagtttaatagtcaggagagaaatatgtatatcagtcggaatatggaacaatggaatgaatttcttgatttaatgagaaaagcatttgaacaaggcaaagaacaagaactacttactttgctacttactgctgatgagcgagatgcagttgcactacgcgttcaaattgtatcccaattactggataaatctttggcacaacgagagatacaacaaattttgaatacaagtgcggcaacaattaccagaggttcaaatatgattaaaattatgcctcctgaatttatggactgggttaaacagcaactaaaccataacaataaaaacgaattaggtggtgactaataaaagggtagtaagagtgagaccttaagtcatttttgtttactattttcctatacaaatgcacttctaaacagaaaacagtctttactataaaaaatttacgtcaaaaaaatctgacagtttcatacttaaagagaacactgtcagatttaatttactgtatagtatgatgattatgcgttattaccagtgattttagccacttccgctgcaaaatcttcttcaactttttcaataccttcaccaacttctaaacgaataaagtttgttactgaagtattaactgattttaagtaatcaccgacagaaactgaaggatccataacgaatgcttgaccggttaaagacacttcaccagtgaatttcttcatacgaccttcaaccattttttcagcgatttcttttggtttgcctgagttgattgcaatatcaatttgaatttgacgctcatgttctacaacttcagcggaaacatcttctggatttacgaattcaggtttagaagctgcaacgtgcattgctacttttcttaattcttcttctgaaccggatcccgctactaacacaccaatttttgcaccatgtaagtattgagcaattacatcaccctctaaatactgaacacgacgaatcgtcatattttcaccaattttagcaactaacgcagcacgtttatcttcaaaatgagttgctaaggtatcaatcgttgttcctttgtttgccaaagcgtaatcagcaacttcatcagctaaacctaagaagccggtatcttttgctacaaagtctgtttcacagttcagttcaactagaacaccaaaaccggaaccaatgcgtacacgaataacaccttcagcagctatacgacctgctttttttgcagcttttgcctgtcccgatttacgcatattgtcgatagccagctcaatatcaccatttgcttcaactaatgcttttttacactccatcatacctgcaccggtacgttcacgaagttctttaactaatgctgctgtaatttcagccatcttaaattcctctatccatttgattaaatagtatcggttttagaccgcactttatcgatataaaaagcagggaactaaaagccccctgcgtttaattaataagggcttacgcctttactgaattattctgctgctgcaaaaacttcttcagttaccgtttcttgattacgaccttcttttactgctgtggtagctgcagaaagatataattgaattgcacgtgacgcatcatcgttacctggaataacaaaatctacgccatctgggcttgagttagtatcaacaattgcaaatacagggattcctagattatttgcttctttgattgcgatatgttcatgatctgcaccgatcacaaaaattgcatcaggaagaccgcccatatctttgataccgccaagacttaattcaagtttttccatctcacgagtacgtactaacgcttcttttttcgttaatttatcaaaagtaccatcttgagattgggtttctaaatcttttaaacgtttgattgattgacgcactgttttccagtttgtcaacatcccgcctaaccaacggtgatttacataatattgttgacagtctaatgctgctgctttaacagcttcagaagctgcacgttttgtaccaacaaataaaattctgccgttattactcgcaatacgagttaattcaactaacgcttcattgaacattgggacagttttttctaagttgatgatgtgaacaccattacgaggtccgaaaatgaacggtttcatttttgggttccagtaacgagtttggtgaccgaagtgaacgccagcttgcagcatatcacgcattgaaacttgtgccataagataattttccttttgtttggggtttagcctccacatatcaagcaaatcgaccgtttggcaccccgatttacttctcatgatacgtgtgtgatttcgtaagttaattgttaaattgacaactcaaaataacgtcgcactttataccacaaagtgcggttaaaaactagaagaaactcttaaattttgcaaaaaaataatgcctgataacttcaggcactatttttgcaattcgaagaaatgtaaacctgcttttactcttcattaatgaattttgtattaatttcaatactggctttttctcttaaggcttgaataagcaaattgcttaaactaaattgcttaatttttgctatttgaacgccaaataattgtttttgctcaggcgttaattggctattttctacgttcattaactcaacaaaaacaatatctccaaacatatttttcgctacagatatggttgttttgcccgggtcaggttttttcattgagaatatcactttgcctaaaacaggatctttattatctgcatctctataaacccacgtttctttttctgaaaaatgaatataagacggtaatttgaaatcagttattgtattcatctctgcaacgattttctctgccatattaaacaacgtagtttcggctttgtgacgttttaaataagtttcaatatctgctgttgcctcagctagtgtacgaataccctcaggtttataatcaactacacgcagaagcacggaatgttgatcgccaacattgattgcctctgagtttataccgccttgcataagatcagaattaaaaatggcggtagcaatatgactataatttaattctggtggtaaatcttgacgagaaaaataatctgtttctttgatttcaagccccgctactttagctgcttcttctaatgattgcggattttcaaacgccttttcattcatttgtttttctaatgaataaaaagcatttgttactaaatcattacgcaatttagttgcaatttcctctttaacatcatttaattcacgggttttcatatccaatactttaatgatatggtacgcattatccactttcacaggctggctatactcaccaacatttaataacgtcaccgcactttcaaaagcaagaggcatcattccattcacaacccaatccaaatctccacctttttgggctgataatgtgtccattgaatataattttgctaaagcagaaaaatcttcgccattttgtaaattagcataaactgattgtgcttcttgttcagtcggtaattgaatatgagctaaatgttttgttatatattgagctttattatcttgataatattgtgcaatttctatatcggagatttttactttctgatccgcaatcgcacgagttaagtctagatattgtactttaactctttcaggtacagcaaagttagctttgttagcttgataatattgttcgatttcttgctccgttacagtttgtttttgcatttcgtcatttaaagatagaacagctaaacgaacatcacgacgttggaaaaaattctttgctaattcattgagttgtataggaacctgaaaatcactatttgcaataccttgctgtaattgctctaataccaagccttcacgcacatatgcagcataagtatcagaactaataccacttgaagctaatatctgctgataaattttattgtcaaatttgccctcattttgaaacataggtgagttcacaatagctaaacttacttgcttatcgctaattcctaacttaagttcttgtgcatattgacgtaataattcttgattgattaaacgatcgagaacttcatgtcttagatgtttagctgccgaatctgcaacttcagcaaatttagctcctaaattttcacttaaacgttgatattcattgttatattgctgtagaaaaacttgttgagaaatttcttcgccatttacttttgctacagatgtatctgtccgtataaacatataacctgctacgccactgagtacaaaagaaaccccgattaagccaaaaataattttagaaactataccgctagaggcattgttcaatttttccattaacattgaagaaatcctataaatgttagattaaaaagaaatgtgtaaaattataatcgaaagtagctcaattcgcacgattaaaataataattcatcaacaaaacactttattttatagattgaattaattctgtggcagtgcataagatacggtatcttagaattatgataaaaatatttaactgatctaaagtagtttaaaagtgcggtgctaattcatgacttttacgagtcatacataaaaaaagagtggatttcccactcttttattaaaaaccaaagtcttatctttttatcattcaaccactaaagcacggcaagtactcgtaccatttgacgttaagtggtctccttgagttaataaaaccaaatcaccggaaactaaataacctttatcttttagcgattgtatggctgcttttaatccttcaagcgtacgactatcctgatcaaaatgaattggaataacaccacgatacaatgcacataaatttaatgtactttcatttcgagaaagggcaaaaattggtagtccggaactaatgcgagacatcaattttgcagtatgaccactacttgtcattgcgatgatggctgcaacacctttcatatggttggctgcaaacatcgtagacatcgcaatagtttcttcaatcgtatcaaattctttatctaagcgatgccgagaaatatttacactaggcattttttcagcacctaaacaaactttagccattgctgaaacagtttctgaagggtattgacctgctgctgtttccgcagaaagcatgacagcatcagtgccatctaatacagcattggcaacatccatcacctcggcacgagttggcataggattgctaatcatagattccatcatttgtgttgcggtaatcactacacgatttagctgacgtgaacgacgaattaattttttctgtattccgactaattccggatcaccaatttcaacacccaaatcaccacgagcaaccataattacatcagaagctaaaataatatcgtccattgcctcatcgtcaataacagtctccgctctttcaactttagccacaattttggcttttaaaccagcttgttgagctaattcacgagcataatttaaatcagcactggaacgagggaaagaaacagcaagataatcaacaccaatacgtgcagctaaaataatgtcttctttgtctttttctgtcagtgcgttagcagataacccaccacctaatttattgatacctttattatttgataatggaccgccaacaattacttctgtaaatactttagtattgtctgtcgataatacttttaactgaacacgtccgtcatccaataataaaatatcgcccggaacaacatcttgcggtaatgttttataatccagtcctacggcttcttgattaccttcacctttgggtaaatcagcatctaaagtaaaattatcaccaatatttaagaaaattttaccctctttaaaagtagatacccgaatttttggaccttgtagatctcctaaaattgcaacagttttacctaattttttagcaatttcacgaactttttcagcacgagcaagatgatcttctggtgtaccatgagaaaaattcatacgaacaacatttgcaccggctacaataattttttctaaattattacctcgatctgtggatggtcccagtgtacatactatttttgttcttcttagtcttctagacattcgttactccgtttaattattttgaataatataagattattaatttagtaaaacccgctcattatatgcttaaaataaaattagatcgagatcacattttggaaaattcttattatagctggataatggaaatgaatattcagattttttctctttttcttttcatgactgttgataaagtaagacttttatatattctttaaaaactttgttaatcatcaaccgcaccaacacacaaaaaaagcagtgattgctcactgctttttcacggtcattgaatgaaacctaccaggtccagccaacccctacaccaccgccgaaatcaccggcagagtttctgctaccatgtaatttcagcattattttaccattatcgctcaaacgcgaataacctaatgccaccgcattgtttcctttataggtacccgcagataaagcaaggctcgatttgcccggcatcgttactgtaggcaatgcggcagcagcatgtgctccagcaaccccggctctcaagtctttattgaatatctcaattttattgtcgagatggttgaatttttggtcagtatgtgtctgcaaggcatcgacatatcctttgttgaccacggccttcggtgaagagttcggcattaaatccggcactctgatttctcctttctccccgtcaatctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatccgttgccgtcaagacgggatttattcccctctgcggtttctttggtttcaaaagangtcatntttttcaacttatcggacagtttgacttccatcccgctgtcagaagcagtcactttaatattgcccgccgccgtggtcrcactgttaaactcgccctcgcctttgatggtcaawttctcgcctaaatttttatggacaggcacgccgtcattgccctcaaaatttaagcccgcttgtcctaaagcctgcaagtcttgcaagtttgccccacggtgaacatcgacgctgttatcatccgataataatttattaattgcaccatcttttgcttttaatgcggtttgataggcgtcttgcttcgcttttaatatgccttgtgccgattcaacctcttttttcgccttatccaatttcgagttaatgtcggctaatgttgatttttcgccctcgatcttagctttggctttctctttcgccgctttttcctccggtgtagtttccggcatgaaagacaatgcggtttcaagagcgtcaatggcgtcctgtttcgcctcttttgctgtttgtagcgtcaacatatcgtctacttttttcgccaccgcctgtgcttcggttttcactgcttcgcctgcctttttcacgttttcggcatgctctttygctttgtcrgcatcaatacccaamccgcttgccacgttgcccagcactacaggkttatcggtttcaccaccggtattgacyagmgaaagttgcgtatttaccgcacttttatccgctttcggtgtaccgttatyctcaacatcttyggctttatagtayttaccrtcrttrgctttgacyarwckwtyrccktkwtkatckgtaaayaccacmgttccmrcytcrccatykcgtaaagcgttcgctttrtcrttggcrtttttgccrttyaaaccgtctttrccrgttaagcctttmgycgccatcgattttttgccgtctgatgttttttcaagacctgacaatccatctttaccgtccgcaaagaccattttcttcgctttcggatcggtttcagaagaacttgggtcatcaatgaatttcgcccctgtcgctttgacaagctgtccaccgttgaccgcatctttggagtcagtcgataacttgccatcagcaatattggttacaaccatggcttttggctcagctttgatcacgacctcgctttgtttgtccttaataggcgtaacctgacctgttccatctttggtgtatttgccatcggcatacttcgcatcctttcagtcggttggcttatagaatttaccatcttcacctttaaccactttttcattatctagataataatcaaatggtctatttgaattggctgatgaaagtttttgatcaagttttttaacttccgtatccacatagtttttattggcgacacttgaaccatcggcaccatcagctaaatcagcaagaccggtaatcgcacctatatatttaccatcagcacctttaccaaaagatagggtcgctttctctttctctttacctttaccgtctttatctttggtaactttcaggctgattgcttcagttgagccatctttacctttcacggttaagccgtctttaccataaacagtgtgggttttatcgccattagttgcgtctttatcacccacggttaaacctttatcgttcaaggtcgcaatagtcggattaccatctttacctttcaatgtaattgcattgccgttgatattaacagtattacctttgtcgtctttaaactcggcagacttcaagccttttaattcctcattgagtgaaatttctagcttgctctgagcactatccgccttcaccgcaatattgccgtcggtgcctttgaatgtagtaactttagctttatctaagcctttgcccacaatctccagtttttcgccaaggtttttatgcacaatgctgtcgctgtcattgccggcaaaatccagtcctgcttgtgcgacagcttttaagtcgacaacattcacggctttatgcgatgaatctttatcaagctcgcctgacacgagttttttcaccaactcacgttgtttaccttgtgtggctgaagcaatgccactgtctttaatatcatcaatacccaaaccggatttgaggttatcaatcgcaacaggtgcaactgttttgcctgcttcaggtttaccgcctagagtgatggatgtttttgtgtcatcatcatatttcaccgccactttctctgcttcggagtgttgtgcggtgactttccctacaatagccttggcaaccgcagacaagtcttgaacattgacagcattgttggcgatcttgctgccattggtattgtccttatcaggtgttccagcgagtacgttttcaatgatactgtcatcattggtactaccgtcttttaagcccagcccactcgcaagtcctttaatttgtttggtatttaaggttaatccggttctgtcaaagacaaaggttccaccattggattcaatgacaacattagtttttggttttgtaccattcgctccttgtttgttaaattcaatgctagaagcgatttttttacctttgccagctccgatttctcgacctccaatagacttaatgcctttcaaatcagaattgagagcaatttctagcgtagaggcatttttcttcgctgtggtagtgatattttgatgtgttttagccgaacctgaacccaccttacctttaattttcaagctgtcattaacggtaaatttagagcctttattcccctcaacttcaaattttgttgcatagttcattaatttctctgccaccgctttggaggtaaccgctctttcatcgtgttcggaaaccttatccgctttatttagggttaaagttaacttagccccgtttccgtcttttgtaacacttgttttgatatccttttctttcatgcctctatcgtctttcttggcttccgaactatcgatcgtcaacaacttgtctaagttgaccagttgttctgtttgacctgagtcatttcctttgaatttaagccctctttcgtccacatattttttattggcggcgtcatagttgtccgttggatcggcaacaaacacaattttccgcttatgtcgcattgacccgactgacaatgcattggacttcgccagcgaacctgtccccaatacaatggcattatgtatctcatcatctgccgtgatattcgagcctaagatgatgttttcgtttccttcaacttcatttcttgaaccgattgaaatattctgtttaccggtgattttgttgtccgatcccattacgtaattttgttctttctcaataacgttattatcccccacggcaaatgagaagttgcctcgtaccgtgttttctctaccgataccgatcgaactcattccaagcacattggaatcttgacctattgatactgcacctgtattcaatgcgtttgctccgtaccccatggcaatagatccttcatttctcgatatcgcaccatgtcctacagataccgaaccatcccccaacgcttccgttgttggtgaatccgacactttcacggatttatctcctgtaccttttagataatctattaatgcttgtgcttgaactaattccgtcgtgctttttttaccattttcaagatttattttgccaataccgacattttttccaaagtcagcttatttatcatcaatattcgagccatctacttttaaatacgccgtgcctaacttatcaactaagtcagtagtcttggtataatttttcaacgcctccgcgactgcttttgaggtaacgacttttccgttgttttcctccactttatcagctttatttaatttcagcgtaagtgtaccggcactttgagggtctttatcattagatggtgttaatgataccatgatgtctttttcaacagtcgcactatttgctccagccgtatcgctactgctaacaggcgcgctatcaatcgtcaatgttccgcctaattgtaatgtggtttgagtcgacttgccatcattgcctttaaaggtaacacctttattgaccgctgtaattagcccactaatcgcatctttataggtcgtgtatttatcttttgaaacggtagaagttgtatctgtatctgtatcatctcccttaactttagtaaatgatggtgcggtaaagttaccagttttatcaacagaaagccctaaattaccgactaaatcgtgaagttgtttaccattaatcgcatcagttgaattctctgcaatctgtccaccggcgacatttgagattttaacgtttttatccgtgtcagtttttccattcactggggtaaaagttaacgcatgtccacccacttttaactctgctgtgttcgtgctacttgatccatctgtgctactcgtattatttttaaacactaaagcgttgctgtcatctttaccaatcgactcaataccttttaagtccttattaagtgcaattgttaactcacttccactagcttttgtagtgatattttgatgttttttgttatctgtagctgtagcatttttagtttccgccccttttatagataaagtcccactgatattatcagtattaccatcatctgaagttaccataaatgcagaggctttgtttgctagcaaattatccacatattttttgttgacggcgtcataatcttgctctggatcgcctacaaatactattcttcttctatttctaggtgttccgactgataacgcattagataccgctacagattgatttcctaatactattgcattttcagtatcttcaccaacatttatacgtgagcctaataatatatttccagttccagagacttcattattagatcctaataatatattttcatctttttctattttattactagaaccaatagatatatttctttcaccacttatattattatttgatcccattacataagttgatgttgattttgaacctatctcattttcatctcctactacaaatgagaaattaccattaactttattatctttacctaaaccaattgaatttacgcctaatacatttgagccttgtcctattgatatagaccctgaatttaatgcattggctccatatcctaaagctattgatccttcattttgtgattttgcatcgtaccctatagaaatagagccttctccctctgcaattgtttttgaagaatcagagacttttacagatttatcccctgtgccttttagataatctattagtgcttgagcctgtactaattctgttttttcttcatcatcaagttttatttcactaattcccacattagatccaaattctttttgtttatcgccaatattttctccagtgattcttaaaaagtcttcttctaatgtttctgtagtagcgaaatcttttaatttatctgctaccgcttttgctacatcggataaatctttcacatttactgcattgttttctatattctctatagaatttccaccagttaatacattattaacattacttgtggtagctccgccatcgcttggtgtagttgaacctattccacttgcaacatttttaatttgcttgctacctaaatcaagactatctttatctaatttaacagttgccttatttttaccttcgcctactgtaaatgtaatatgatgagtagaatcagcactactaaattctattttagccttatcatcttttccaatagaggtaatccctgttaaagccttattaagcgatacggttaattttttattgtccttatcaacggcggttgtaatattactatccccattaatatttaattcattatgatctttattaaggtatatacttgtgttttctccctctttaggcgtgtcccccttaaccgtgaaattagcggcgactttttctaatcttttgtctaaatattttttgttgacagcatagttatcataagtatttttcttagcactatctgacgtatcctcaggaatttcttctgtaattaatacatttttaaaagatggtgtttcttttatacctattaagatatttttgttatttttttcatactgagttctaatattatcgcttaaaaatttatcttctttgtttaaagcatcatctttaaccgttgtattcccagccttaatgattaatttatcgcctagataatgcattcctttttcatcgtcatctccactgccaaaaacaaagccactattaannnnnnnnnnnnnnnnnnnnnnnnnnnnnnnnnnnnnnnnnnnnnnnnnnnnnnnnnnnnnnnnnnnnnnnnnnnnnnnnnnnnnnnnaaattctgatttcttaaatcctgttttgtcagcgtcttcaacttccgcacccaatacattcaccgctaatttagaaaattcatcggcgacggcgtaaagttggtttccgttgatagcgtcggttgaatctgacgttaccgcacctgctgcgacgtgtttaatgatacgctcattatttttcttacctatgcttaaaacggattttttattattttcttgaccattagcactcactcctcttttgaaattaaatttaacattaatagcctctattttagcttcattaagtgcggtttcttttttagtcgcttgtgagccttgccccaasgcaatrgaatcccctgckgckgtttcaaccaccgcactttskccwatggcgacaccgccctcggctttagattgggcttgataaccaataatcactgcgttttttgcwcctgaggtggcttttgtttctgctccaataagtacgctrttttytgcattttgggcattrgctttattaccaatygcaaccacatktgtattagcatattcgtcagaaccattattctcaaatcctatattaatattgttccctaacgccagtatatcggtcccgttttggattttgtttttattcccgatagaggttgtccatgctgctttttttatcatagttccctcagttccatctttaccattcgcaaaaaccgcaccgatggcaattgaactcttggactcttctaattttgttccgctaccgatcacaacgaccgcacttcttacatccttattagtttgtgtaactgtattattkgaacccaacacaaaygarttwgstacatcaanactgacatttgtccctatgacgatagcgttttgagcttttgagcttgccccattaccgatcgctacgccggaatcagctattgcactcgcaccgacaccgatagcaatagccttatttcccgttgcccctttgttatcataatttaaacctttttgagtaggattattcaccgacaaataatgcaaagttcctacattttttacgcctttcatcgcttcttttaattgagcaaggataacaacgtcggtatctttcgtacccggtgcgacgttgacgatttgtcttagaattgtttttttatctccgcttttttggttactgatatcggcaatatctccaccatttttcccaacagaaacgggagcatacatattaccatctagttttcctgctaattctttactaatatacgcagtgtcatttgctttattaatgcgttcatgtgccctatcagcaactgattgataacctaaagctactgcattcgcatattttgttgaagtctcatttcctaataaaattgaattacgagcttccatatcatctatcgtagcatttttccctataacaatagagttttcagcatttgatttagcccctacaccaattgccattgaacctgattttttagctccatcactaaggaagttacttttagcaaatttttctttttgttctgggttaaataatttttccaatttttctttggctgtatcctggttataagcattttcaatatctttatatgcttgttctaaccattccttgcgttttttcttttctaattcaggatcttgttttgcattctgaggtagaagtaaactataagtcttatcatcttcagtttttaatttttctgcgacagttttaaagtcgttatattttttttcgtaggcttctactttactttttatattctctaaattaatttcttcgttgtttctttcttttctcgctttgagttttaaatattcctttttaactttcgcatagtttttgtaatcctgttcttttgtgactaataactttaagtcatctaagcctttgacagagacatatttcacgccggaattaatattatcttcttctaacgtatttccatacaggatagcttcttctaaggctcttaattgagatacgttgaccgcatcggtatcgctcgcacccggtgcgacattgacgatacgtctttccgcattcttgccacccactgacaaatagccgattctttctgatgaaggtattgatatggcatttttaggtgcccatccgccttgtgccatttcagtttgagtataatcagtttttgcattgacgcccaatgcgatggaatctgaaaaagaggcttccgcaccattaccaattgccattgcatttttaatggtaaaatctgattttctattgttcttatttttttcactttgaagtgcggttggcatttcagctaaaacttttgcttttatacctaatgccatagaatcatcagcttctactaatgaatgagtaccaaaagcacctgattgtttacctaatgctcttgtgaaatttcctattgaaaatgaagattctttttgtgcaaacgcaaatctaccgagtgcaacagtactatcttctttcgcataggcatatctacctaatgagattgcattatcccccaatgcaacagagtatgaacctatggcaatagcaccttgattatgtcttccctgcctatctttagattgctctgctttttcttcgcccgttccttcttggacggttgtgtgggcattaatatgttctttcattatatcttgtatcgctgctgtatcaccgaaacgatataaatcttcaatagtgattttgttggctgttaatccttgtggaccgccattagtgtatgtagggtaattttgtttaccgtttactaataagttatattgatcaatagtaagcccttcaccattaaataccttacccatcttcacattggcaaaggtgtgatcaccaatcgctaacgatcctaagccccctgcaaaagagtctttaccatataccatagatccggcaccgatggcttgtactttattcccgatacctacagatccatctgcatagacatagctgttattacccatcaccaatgaacctttaccaaaggcgacggtgtttgagccgatagcggttgaataatccttagtcgctacagcaaatgtccctaaagcggttgaattatctccataggcaattgaacgtgccccaatagcaatggcgttatttcctcttgcccaagtatgtgttttggtatttctacgatctgctaaatatttttgataagcctctccttctttttttagatagagttcatatcttttatagtctgataatgcctttatttgttttattttttcttcatatcctggggtgttaggatcgatataatttttatatgcggcgttttctgattcaacatcataaaaattttccccctctatgcggtaatatccacctttatagtctttaccattttttctcacaaaatatgtgccgttttgatatattggtgtgtaaccatcttcagctaataactgtccttgatcattaagcataggcttaccgctatcatctttcataatctcaaaatcaacggcagcatattctttggtatagttaaaatcatttcttacattataaaaaagtctaaacatctctttagaaagcggtttggcatcatgccctgcggcattatcgctcccgatagaaatagaggaatctccccatgccaccacatcgttacccaaagcggtcgcttcttcgcctcgtgcaaaagatcgataaccgacagccgtaccttctttatttaaagctcttttaggatcttttttgcgtttctctttctccattattatcacttggttaataatgtctcgttttttttcttctgttgtaggtttccacttagtattagtggcaaattcaaaatacttttctcgtaagtctttatacgaaccatcttcgtctttgagcagaatagattttgcttcttcttgcgtaacggttggattgtgagctgaagtcgctgtattttctccggtagcggctccaaaaccgatagcggttcctttatcaccgcccacgactgctcgagaccctatcacaacagtttgattaaagtctttattgctatacgaagcattttttcctgttttattagcataatccgagaggataaccgcttcatcgggaatatcagattgtttatatggtcgattccaagatctatacataatttgcgttttacggtttagggtgcttatcgtttgtccatctgcaacatcagcactatgaacccaaacatcatacccatacgcaactccagacaatgccccmsccaycaccaacgccaacggcaggascttaaacgcccctaacattccgccgaaaaacacaccgcacttcggytgacttcccgccscctcaacacggctcgccacytgacggttattcgctaattcagacacaactttsgtttgacckgttgttacatcgtatttggttttgaagattttgttcataaattcactctctttaagcttttaaaattaggttwtttaataatgtatrttgtygattttttaacttttacggttgtttattgattaaacgtgttactttttagatagattgataaataaatcggcgatgccttgctttttaagacamarcaraaaaaggcgaataatactttcgccgaaaggttgaggttgaaataggtgatttttatttttaagatattgtttgaacatgtccaacctctcaaaattaacttgaaaggttgattttagccaatatactaggctgtrggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtcatttttttcgttctattttgtttgtcaagtaaaaattcggattattctatctcaaaatttttacggaaaaaacgattttttatttttttattcacttttttgtttgttatcagccaaaagatgatttttggcggcggctaaatactgaaacattgaccaaacagttaaaatggcggcgatatataggaagataatcgctgtaatttccattaatgtgttgtaacgccacaaaagaccaccgagggagagcatttgcgaagctgtttttacttttcccaaccaagaaaccgcaaccgtgccacgactaccgatttccgccatccattctcttaatgctgaaatcacaatttcacgaaaaatcataataattgcaggtatcgttacccaaaaagaatgttgatattcaacaacgagcgtgagtgccgcaatgaccataactttatcggctacgggatctaaaaatgcaccgaaacgggtactttgattccatttgcgagcaaggtaaccgtctagccagtctgttattgaggcaatgaaaaaaataagcgtagtaagaaaaggtgcccagctaaaaggcaagtagaatgccacaataaaaaaggggattaagccaacacgaaataaagttaaaattgtagggatattgagtttcataatattattttggatagggtagggatacgctgtattctaaagtatatcccttatttttaaaagtctgatgaaactaacaaagcgaaataattagttatttttgatatgagattttaacgtttgttcaatttcgtaaatccaatcaagttcatattgagtaaagccggcttgaatacgagcatcagtattaatcacacctttaaaaatcacaatgcgatatttgcgtaataattcgctgaaacatttcattgcatctaattgacgtttagcggaaagtgcatgataccaatgatttccaatagaaacatgaccaatttcatcacgcaaaataatatctaaaattgccactgcctcgacgtctttacgctgtgcaattttttcttgtagtattgggtttgcatctaatcctctggcttccaaaactctaggtaccaatgccatacgttcccaaatgtcatgagcagtcgcttgagccatttcccataagccggcatgtgcttcaaaatcaccgtattgatatcctaatgtgtttaaatgctcattcacgagagtaaagtgagtgctttcttcacgtgcaactttgagccaatcttgtatgaacggcatgccttgttcgagttcttcttgtgcgtgacgtccaaatctccacgcagcatctaaaccaagatttatggcgttaaattcaatatgtgcaatggcgtgtaatgttgccgcataaccttcgtttgtggcaaaagaacgtttcggcacattttggggagcgacaaggaagggtttgtgtggaataccgacaatttcttgttcaggtgtaacaagaggaaaatcgtccgtttgatctagatttatcgtaggcaaaatttcatcatataactgattcactaaacgacatttttcatagggatttgtttctgccagtgcggttgttattttatgccaaaagtcttgagttgaaagtgcggtcatatttttccttatttcatagaataatttttaatcgctcaaagtatagttatcagagaaagatttgcaatcggaatttgcttataggataatgcaccccattagccgttcggttaattctatggaaatcttttcggttcctcgcaatagtgtccgatttactcggtcaggttcggaagaaagcagccaaagtcggaatttctgtgtgccgagatcctgccggaaaggtttccgcccatctactacatttcaatatgtataaaaaaagcaacttttcagttgcctttattcaatttagctttgttcttttactgcctctaatgcacgcaaggcataagtataagccgcaccagcgttcagtgcaatcgcagtagccaatgctccggcaatttcactttctgttgcccctgctttagctgctttttcagcatgaacactaatacaactttcacaacgtgtcgtaatagcgacagcaattgcgatgagttcacgggttttttcatcaagtgcttcagccgcagctgcctgatctaagttaatataggcttgtaacatttttggatgagacttgcccaattcgccaaaagattttttaacatgagcggtatgctctttccaatctgtgaatgttgtcataagaatttcctcttgttgttaatcaagttaatgttgataattaaccgcacttttataacttgattgactaaaagtgcggtgtaatttgaacatattttttagatttaaattcgttcaataagttgtttaaaaaatcctttttcttgttgaatcagttgatggtaatgtccttgttcaactagatggctgttatccatgatacaaagtaaatcgaattgttcaagtgctgttagacgatgagtaaccataatgaacgttttattttgacaatgttcaaataatagcgttagaacatggcgttcagtatctcgatccagtccttctgtcggttcatcaaatagaataatgggggcattattcagtaaaactcttgctagtcctaagcgacgctgttcaccgcctgataaaggtcgcccgccgtcgcctaaccataaatccagtccttgatcctgctgaactaatttttccagacctactttttgtagtatatgacacattttttcatcgctgatttgttggctacctgctatttgtaaattattgcgtaaagtatcactaaaaatatgtactcgttgagtgagtaaacagatattttggcgtagcgtttcttcggtataaacttgaatcggtgcattagagagtaaaatttccccttggttgcaatcatagtttcgaaccaataattgcagtaaacttgatttgccactccccgtttttccgagaacagccactttttttccagcttcaacggtgaaattaatttgttgtaatgcctgatcattgcgatccggataagaaaaactgacatttttcagttgaataagcggatattcattgttttgcaatatgcgagtaccgttgaattgcactaaaggtcgttgtgcaagaagttcattaatgcgttctgcagatgaaatgacttgtccaatatgtaagaatgcggcactaataggcatgagaagctcaaatgaggcaagagcggcaaacgcaaataacgcaataaaagcattgtgataatctgcaatggaaaattgtgctttcgccgcaaaccaaagggttattactaccagtaatccgttaataaatacgacaagtgcggtagataatccgactaaatttgtttcttgttgttggtaagattgccattctaattcgattgcttttagtttctcttttgagctaaaggctgcattaaagagtaatagttccgcttgcgactgaataaattcgataaaataagtgcgataaactgaacgagattgagttaatttagcaccgaatttacgtcccagccgataaaaaacgatgggaataatcaaaagtagcaacagcaggcttataccaataaatacgccgatagaaacattaaataaacttaagcctaacgtaataaaagcaataacaatcattgcactgataaaaggggcaataaggcgtaaatacaatgtatctaaagtatctacatcagccactaaacgattaagtaaatcactgttgcgatagcgattaagtactgcggggcttaaaggaataagtttactgaatacttgaacacgtaattttgccaatacacggaaagtggcatcatgcgtcactattttttcaaaataacgtgttacagttcgaccgattgctaaacctctgacacttgccgacgggtagaaaaaattaaataatgtgccaataccggctaacgccgtggcggcgagaaaccagccggatagggttaataaaccgatgcttgaggctaatcccgcaatcattaatattccccctaaaatgagagtaaatttagcgtgataaaataagcgaagaaaaggaagtaaagctcgcattattgaatttcctgtttttgttgagccaaaagttcggcgaagaaaccttgttcttttaattgttcaaaacggccttgttgcacaatttgcccttgttgcatcactaaaatttggtcgcattgttttagatcttcaatgcgatgcgtaatcattaaagtagtttggttacggctaattttttgtaacacttgtagtacggcattttccgattttgcatcaagacttgcagtaggttcatcaagtaataataaattgctttgacgcaataatgagcgagcaataacaagacgttgtgcttgtccgacggataaaccaataccgccttctctaattagaaaatcaagtcctaatttcgcacaaaaagacgtggcttgtgcttgttctaatgcttgcgtaatttgttcgtctgttgcttgaatatcaccaaaaagtaaattttctcgaatcgtgccttgtaataataaaggattttgccctacccaagcgatattttttcgccattcgtttaaagataaatcatgcaattcaataccattaatttttaaacttccctgataatttaggaaaccgagtaacacgttgattaatgttgttttacctgcaccgctttgcccaactaacgcagtattgttttgagccgacaagcaaaaatttaacggagcggttaaaggatggccttgtggtgaaagtgcgatgagatttttcgctataatttcgaccgcacttttaggctcgatactatgtgtttgttcatattgttgagaagtaacttcttgctccaaaaatttaacgatttcatcggctgcaccaatacctgctgcacgatcatggtaataagcacctagatctcgtaaaggttggtaaaactcaggagcaagaattaagcagaaaaaaccaataaataaagtaagttcagtgtcgtaagaaccgaagttaatttgtcctaaataactaaaaccaaaataaactgccattaatgcaatagagatagaagtaaaaaattctaatactgcggaagataaaaatgccatttttagcacagtcatagttgtttcacgaaaatcttcagtgctttcttcaatatattcagtttgctcttttgctttattgaaaaggcgtaatgtttctaatccacgtaaacgatctaaaaattgaccgctaagttttgctaaggcggacatatttttttgactactatctgcggcggctaatccggctaaaatcataaaaataggaataagcggagcagtaagtgccaagattaatcctgccacccaattgagtggaaagacagcgattaagataatgattggtgtaatggctgaaagtgcttgttgaggtagaaagcgagcataaaaattgtgcagattttctacttgttccagcatcaaggttgcccaacttcccgcagatttttggttgatcattgccggaccagcttgatgaattttggcgaaaatttgttgacgaatatgatgacgtaattgttgaccgcatttaaagcccactttttcccttgcccataatattaaaccacgtagcataaaaccaagaataagtgctagaaagtgcggtattaattcacttcgatccgtatttaaaataatgagttgatgaagcaggtagcttaaaatataagtttgtgcaactaaaataatggatgaaatagttgcaagaataatattaagcgaaagcaactttttgattggcttttgttgtttgcgtagccatttgaaaacatacttttgacgtgatttttccattgttactgctagaggttatgatatatttgtggggcagattagttgccccaatacgactgagttaattatttttgtgtatccaaaaaacgttctgcatctaaagctgccatacatccagttccggcagatgtaattgcttgacgatagttgtgatccattacatctccggctgcaaaaactccttggacagatgttgccgttgcattaccgtccaaaccggattttacgacaatataaccgttgtttaattcaagttgattggcaaacaattcagtgttaggagcatgaccgatcgcaataaataccccttctaatttaagatcttcaacattttctgtttgtgtgttttttaaacggattccggttacgcccatattatcacctaaaacctccgctaaagtgcggttcgtatgcaggataatttttccttcttccacttttttattgaggcgatcgattaagattttttctgcccgaaacgtatcacggcgatgaattaaatgaacttcagaggcaatatttgcaagatataaggcttcttcaacagccgtattaccgccaccaaccacagccacaggtttattgcgataaaagaagccgtcgcaagttgcacaagcggaaacacctcgtcctttgtaagtttcttctgaaggtaagcctaaataacgagccgatgcacctgttgcgataatgagtgcatcgcaactgtaagcccctgcatcaccaaatagtttgaatggaggttcagataaatcgacattattaatatgatcgaagacgatttcggtatcaaatttttcagcatgttgcaacattcgttgcattaattccggacctgttgtatcgccaaagtctcccggccagttttcaatttcagtagtagttgttaattgcccaccttgttgtaatcctgtcaccaataccggttttaagtttgctcttgccgcataaattgcagcagtgtaaccggcaggaccggatcctaaaataagcagtcggctatgtttaatatctgacataaaaatccttgttagtgaaatgttacaagattgcgaattcgcttattatagagatttcaagaattaaatctataattaaatagaaaaccatagtggctattatgttgctggagacactatttttaacattaatatttgactgtatggccataactttcaatgatagatttgatatgttccagcgaatccttggttggcggtgctacatcttccagttcatattgttcgcccatcgtcttccatttatgtgcacctagtcgatgataagggagaagttcaacttgttcgatattgctcatattttgaataaattgacccaataagtgtatatcttcatcagcatcagtataaccgggaacaactacatagcgaatccaagttttttgattgcgtttttgtaggtatttggcaaattctagtgtacgcttgttcggtacaccgataagattttggtgcactttatcattgagttgttttaaatcaagtaaaacaagatcggtaacatctaataattcatcaatgacatgatcataatgacgtacaaagccatttgtatccaagcaagtacttattccttccgctttacaggctttaaaccaatctcgaacaaattcagcttgtaagacagcttctccaccggatgcggttacgccaccgcccgttgcattcataaaatgacgatacgtgaccacttctttcattaaatcttctacactgatttctttgccatcatgtagatcccatgtatctcgattatggcaatatttacaacgcattaggcagccttgtaaaaataaaatgaaacgaattcccggcccatcaacagttccacaagattcgtaagagtgataacgtgcaagtacagacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaacagcaaaaatcagtcaaatttacggtgatattcctattgttcacggtatgccgtttgtatcgggtgtaggtattgatgaattaaaagaaaaaatcttggttattttaagaggataagattatgttcacagaaattatgcaatatattttggatttaggcccagcggtaatgttaccactggtaattctcattctctcgctagccttaggtatgaaattcggagagtctttcaaagctggtttatctatcggtatcggctttgtagggatcgggctcgtaatcggtttaatgttggactctattggtcctgcagcaaaggcaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagataaaaaatggcggtaattatatcatgcactattaatttgtaacttattctttggattgttcgggaataatgacccctaaatcgatccatttgtaccaagtttgttgtagaaattgtagtatgttttcgtcaactgcaaggttttttaaagattcttttagcttttgtagtgaataggctttttcttgtaacagcattaataaaaagtgatctaagtccgttaacttttggtaatacacttcaaattgagcattacgccaaacaattgtttttgatggttgattcagtatttggttaaactgagttgaaagaaaatccaccggatattcttttataaagcaaacctctgagcatttcattggagtttgttctgttatatcgaattcagtcggtagctgaaacattgatacttccgcttgaagttgatcaaattcaaattgcattagggagagaatattttcatcgaaaatatttttgtgttggcaaaattgtaaaaactcacctgcaatatcttggaagtaaggggaatgtgcttttccgtttttgacaaattcttcttttgcattatcccaatcttgtcggtttaaatgagccggagtttcggtaaagcatttttcgataaagccaaaagtattgttgcgtaataaccgcacataaatatttaaacgtctaggatcgtgattgctagagtctttttcacgaatagcttgaacaaattcttgttgcgtttgtgctagatttttagccatgacaatcctctttttttgacatatttttgttgtaattgatggataatatcgacttctttacaaagtttttcaaaaggggggaaattgaaatcacgttcaagtagtgttggtggcatatgaggtaaacgagcataagtatattcaagtaaatcccaaacagtaccttttacattttcaccatgtgtatcaacaagtaattgaggaagatggcgaaaatctcctttgattgtattgaaagactctgatgtttgtatttgcacttcagtagcggcatgttcatcatcatgtccggcaatatgaatgtaattgacacgttttaaatccacattatcaataaagacatgaggatcaagtaatccatggttgaccgcatttacatagatattattaacatctaaatgaataccgcaatttgcctcttgtgcaatagcattgagaaattctacttcattcatcgtgcttgtttcagaatgcaaataataagaggtgttttctactgaaatttgaatttctaaaaaatcttgtacttcacgaattcttgctgcagtgtgttttactgcttcatcagtaaacggcattggcaataaatcatataaatgaccatcgcattcgcaaaagctcagatgatcggaaaagaaaggcgtattatattgttttatcatggctttaatgcctgataacaattctttatctaaaggggcttgtccaccaagagaaagagataacccatggattagcatagggattttttctgccactttatcgaattgataacgcgcaaatcctcccatttttaaccagttttccggtgctatttccataaattgaattcgatcattattgcgtaattgtagaaatccttccgctagatcacgtctgtagcctaaaccggcaccttgtcgcatatatcctccgtgtaaataaaaagggtgcgatgcaccctcaaaaatttatttagatgcaccgcactttccttcgccacatttgccttcggcagatttcggcatatttttcttaggagcggttgcaccgcattttccttcaccgcatttgccttcggcagattttgatacacatttgccatcgtgcatttcacactcggttgtgttttttttcatatctgcatgtgctgatacagccatagctaaggcaccggctaaagcgactaaagttgtttttttcatggtttttctcctatataaatgattaaagtaaattcagccgtttttgagctgagtattttttccgtaacagaaaatcaagtgaaactacacccgcaccttgtaggagcagaggaagtaacgtaattatgtaaatgagcggtaatttataaccattgttgcatacgttataacctaatccgctatgtactgttgcccaagctacagcggttaaaatcatcaaccctaaagcactaaagcgagttgcaatacctaaaaccaacaaaatcggaaacaataattctgcaccggttgcaatagcccaatttaagtctagtggtaaaattgagaaaggaaacggaaaattatcttttatcgcataaaaccaattttcaccgttccatttttctagtcctgcttcgaaaaactcataggcgacaaaaaaacgtaatacgagtaaggataatccctgagtggattgtttaaaaatatgacaatgagacattttctactcctaaaaaattgctttctagaagttagacgaatgagaaaataaaaccttacaaaaaaatttcaaaaatttagaaaaataaaaaggtcagattttactctgaccttttaaatattctgatttaaaacttacattgacgttgtgaatgtacgtgtaattacatcttgttgttgctctttagttaaagagttgaaacgtactgcgtaacctgatacacgaatggttaattgcgggtatttgtctggattttctaccgcatctaataacatttctcgatttagtacattcacgtttaagtgttgaccgccttcaatagttgtttcatgatggaaatatccatccattaaacctgccaaattgcgtttttgtgcatcaatatctttacctaacgcattaggtacgatagagaacgtataagaaataccgtctttagcataagcaaatggaagtttagcaacagaagttaatgatgctaccgcacctttttgatcacgtccgtgcattgggtttgctcccggtccaaatggtgcacctgaacgacgaccatcaggtgtgttacctgttttcttgccatataccacatttgaagtaatcgttaaaacagattgagttggtgttgcattgcggtaagttttgagtttttgaattttcttcatgaaacgttcaaccaagtcaactgcaatatcatctactcgtgaatcgttgttaccaaattgtggatattcaccttcaatttcaaagtcaatcgcaacattttttgaaataccgatcacgtcgccagctttatttttcacttcaatatcaccacgaataggttttactttagcgtatttaattgcagaaagtgagtcggcggcaacagaaagaccggcaataccgcaagccattgttctgaatacatcacgatcatgcaatgccattaacgctgcttcataagcatatttatcgtgcataaaatgaataatgttcaatgcagtgacgtattgttttgctaaccaatccataaagctgtctaaacgggtcatgacgtcttcataatctaaatattcagttgtaataggatcggttttaggaccaacttggtcaccggatttttcatcaataccgccgttgattgcatacagtaatgtttttgctaagttcgcacgagccccgaagaattgcatcattttacccacgatcattgggcttacgcagcaggcgattgcatagtcatcattttggaaatccggacgcattaggtcgtcattttcgtactgtacagatgaagtatcaattgatactttcgcagcatagcgtttgaaaccatcaggtaaactttcagaccaaagaatagttaagttcggttctggtgaaggtcccatcgtgtaaagtgtatgcaagatacggaaacttgttttggtgactaaagtacgaccatctaaccccataccggctaaagtttcagttgcccacattggatcaccggagaataattgatcgtattcaggcgtgcgtaagaagcgaaccatacgaagtttcatgaccaagtggtcaattaattcttgagcttcttgttctgtaattttgcctgctttgagatcacgttcaatgaaaatatctaagaatgtggatacacgaccaaaagacattgccgcaccgttttgtgattttacggcagcaaggtaagcgaagtaagtccattgaaccgcctcttgagcattttttgctggagcggaaatatcatagccgtaagatgctgccatttctttcattttgcctaaagcacggtgctgttcagcgatttcctcacgtaattgaatcgttgcttgaatatcttcgccgctttctaatttctcttgtaatgaagtaaattgtttgaatttatctttcattaagaaatctgcaccataaagtgccatacggcgatagtcaccgatgatacgaccacgaccgtaagcatcaggtaaacctgtgattacacctgatttacgacaacgtaaaatatctggtgtataaacatcgaatacgccttgattgtgagttttgcgatattcagtaaagattttttcaacttctggattgagttcacgacggtaaactttacatgagcctctaaccatgttgattccaccaaacggcataattgcacgttttaagggagcgtctgtttgtaaaccgacaattttttctaaatctttattgatatagcccgctttatgagaagtaatagtggatggaatatctgtgtcaatatcataaggttcgtgagttttgttctccactttgattttttccattacatcagcccacaggattgatgttgcttctgttgcttccgctaagaatgcttcatccccctcatacggagtatagtttttttggataaaatcacgaacattgacttcagtttgccaatctccaccgacaaaaccttcccaagctttttgttgagtttctgttaattgagccatcgctaataacttccttttgagtaaataaaaataaaactgttgaactttgtaaaaacaatcgaaaaacagaccgctcttacaccctaatgatttattagtgtctatgaggtttattggtaaaccattgcattaatgcaatacaaacaccaccgccgataatatttcctaaggtaacaggaattaaatttttaaagataaaatgatagatgtccaaatcggcaaattgcagtggattcatattaatcgcttgccaaaaatctgttgagctggcatgtgaggtaattattcccatcgggatcataaacatattggcaacactatgttcaaagcctgaagcaacaaacagagcaataggtaagatcataatgaatgctttatctattaatgttttaccggcataactcatccaaacggcaatacataccataatgttacatagaatacctaagcaaaatgcttcaagccatgtgtggtgaattttatgttgtgctgtttttagaatggttaaaccccattgtccatttgccgccatagtttgaccggcaaaccaaattagcaatacgataattaatgaaccgacgaaattacccagataaacgacgagccaattttttaacatttgagttgtggaaatgcgtttattcacacgtgcaataagagacatagttgatgatgtgaaaagctctgaaccgcatactaccgccatgataataccaagagaaaaaaccagtccgccgaccagcttggtcagtccccagggggcattacctaaatctgtttgagtagtcgtatagaaaacaaaagcgagagcgataaatgcccccgcagaaattgcagataagaaagaatagcattgatttttagttgctttatagacacctacattctcaccgatttgtgccatttcgctaggtgatactattatggttgtattttcggttttcattacaaaccctattgaaattaaactggcgttattttaagtcattaaccggaaactttaaactaaaaaattttttattttttataaaatttgttaaatgaaaatatttttaacaagtgtttaacatttaattgttttatattttttaaatgcaacaacttattaacattagcaatctaaattgctatttaaagggatttctgatacaaaatgcacctattatttttatatcatgggagaacaaaaatggtagaagaaactatttttagcaaaattattcgtaaagaaattccggcaaatattgtttatcaggatgaattggttactgcatttcgtgatatatccccacaagcacctacccatattttaattatcccaaataaaattattccgacagttaatgatgtaacatcagaggatgaagtaacgttgggacgtttatttaccgtagcggcgaaacttgctgaaaaagagggaatagcacaagacggttatcgtttaatcgtcaattgcaataaacatggaggacaagaggtctatcatttgcatatgcacttggttggcggtgaacctttagggaaaatgttggcaaaataatgaaaaatttacttatcgctgttattttgagtttgggattaattgcttgtagttctttggaaaaagtaaatttagtgcattctcaacagccaattataaatattagtaccgagcttgcttctgatattgacgtacaagtcagccattcatcagcatcgctgacaaacgtttcacaaaagcaagtgacgctcgtatattattttttttggtacgataaaaatggtgtaacacaaggtgatgtggctaatatgaaaaatgccactatgctgattttatcgccaggtcaaacacgtcagttagtattacaaaagccgacaacagaaagtgtgaattaccgcctttacttgagtttatagaacaaaatgtcgatattattaatagatttatcgggtcaagagttacgtcaagaagaaatcgaattacttgaacatcctctagtcgcagggttaattttatttagccgcaatttttatgatattgagcaaatccgacatctcattagatctgtgcgtcaaaaggttaaaaagcctttattaattactgttgatcaagagggtgggcgagtacagcgttttcgtcagggttttacgcaattaccggcaatgcagtcctttgcctgtttactttctgatcctcaagagcaacaggaaatggcttggcgagcaggttggcaaatggcggcggaaatgaccgcacttgatatcgatcttagctttgcacctgttttggatcttgggcatcaatgtaaggcaattggcgaccgcagttttcattatgaggaaaagaaactgattgaacttgctgagaaatttattcaagggatgagacaaatcggaatgtcggcaacgggtaagcattttcccggtcatggacatgtgttagccgattctcatttggaaacaccttatgatgatcgagcaaaagaattaatttttgcacaagatattcgaccgtttcagtctttgattaaacaagggttgttagatgcagtgatgccggcacatgttatctacactcaatgtgataatcaaccggcaagtggatcgtcttattggctaaaggaggttttacgtcaacaattgggattccaaggagcgattttttctgatgatttgggtatgaaaggtgccggttttatgggggattttgttgctcgttgtacgcaatctcttcaggcgggttgtgatttattgttgttatgtaacgagcctgaagcagtggagcaagttttagatcgttttaaaccacaggaaagtcagaataaacgaataatacgccaaactagattgaataaattattcaaaaaacaacggattgattggcaaaccttacgcactcaacgtgattggttggaaaatcacaaaaaacttaccgcacttcagcaagattggttagcctatagggggtaggacaattagaaattatggaggtggttttttgagagtatacaaaaataaagaagaactcaaaactgaaataaataaagcatttaagaagtatattttagaatttgataatattccagaaaccttaaaagataagagagttgataaagttgatagaactccagctgaaaatcttgcttatcaagtgggatggacaagtttggttcttaaatgggaaaaagatgaaagaaaggggcttcaagtaaaaacaccatcggatgaatttaagtggaatcaacttggtcaattatatcagtggttcacggatacttatgctcatttatccttgcaagagttaaaagcaaaattaaatgaaaatattaattctatctatgcaatgattgattcgttgagtgaggaagaattatttgaaccgcatatgagaaagtgggctgatgaagcgactaaaacagcgacttgggaagtgtataagtttattcatgtcaatacggttgcaccttttgggacttttagaacaaaagtcagaaaatggaagaagacagcattataaattacctttttacaaaaaaatttcataaaaacagttaccaaaggcaatagagaaaactatcgttttttcctttgcaaatttaaattttattaaattaatatgaatttaattcatgaaaagtataatttttctgaaattgacacatattttctttctctttatgatgattttaaccgatttaaagataaatttattatggagtaaatgaatatgagttataccaaagaattagacacattaaatcagcatatggttgatattaatgggaaaattaatgtttcttttgagttttttccacctaaaaatgaaaaaatggaaactcttttgtgggactctattcatcgtttaaaagtccttaagccgaaatttgtatcagtaacctatggagcaaattccggtgagcgggatcgtactcatactgttgttaagcgtattaaacaagaaactggtttagatgcggcaccccatttaaccggtattgatgctactccggaagaattaaaggctattgctaaggattattgggatgggggtattcgtcgaattgttgctttacggggggacgaacctaaaggttatattaagaaacctttttatgcctccgatttagttgagttattacgttcggtagctgactttgatatttcagtggcggcttatcctgaagtgcatcccgaagcaaaatccgctcaagcggatttaattaatttaaagcgaaaaatagatgcaggagcaaatcatgtaatcactcaattcttttttgatgttgatagttacttacgttttcgtgatcgttgtgcctcaatagggattgatgcggaaattgtaccgggcattttaccggtaacgaattttaaacaattacaaaaaatggctgcgattacaaatgtcaaaattcctagttggatggcgaaaatgtatgaagggttagatgatgatcaaactacaagaaatttagttgcggcaagtattgcgatggatatggtaaaggttttatcttgtgagggggtaaaagatttccatttctatacactcaatcgcagtgagttaagttatgctatttgccatactttaggcgttcgcccaagtttataaaaaaccgcactttgggcctaaaaaaggactaaattgttaaaatttggtccttttatttttacggattttattaagaaatgcacaatttaaaatggaatgtcatcatcaagtggagcatcaacaggtgatggagatgcaatgctcggtttaggttgagaatgtgattggtaggttggttgctgttgaggttcgtatcctcccatttgtccacgatctgaacgactatccagcatttgcaatacatcgccctgaatttcagtggtataacgatcttgmccattttgatcttgccatttgcgtgttyttaracgtccttcwacataracyttygagcctttrcgtaaatattctccagccacttctgcttgacgacgrtaraacacratacgatgccattcygtwawttcacggcgttcattggtatttttatcaatccaactttcacttgttgcaacactgatattcgcaacagcatcaccgtttggcatggtgcgaatttcaggagcgttaccaagatttccaacaatgattactttatttactccagccataagtcctctaatttgcttcagttaaaaagtgcggttattttgccttaaattaaaaaaaaaagctatgcttaaaatgaactaaactggatatttgcacagttgtttaggaatgtgagataatgatcgcaaaatttacttgattggcttgctattattgtcaatttattgttggtgtattatggaaaaaattgatattcgtggggcaagaactcacaatctaaaaaatataagtttaacaattcctcgtaacaaacttgttgtaattacggggctgtctggttcaggaaagtcttctttggcttttgatacgttatatgcagaggggcaacgccgttatgtagagtcattgtctgcctacgctcgccaatttttatctttaatggaaaaacccgatgttgatcatattgaaggattatctccggctatttctattgaacaaaaatccacttctcataatcctcgctcaacagtgggaacgattactgaaattcatgattatttgcgtttattgtttgctcgagtaggtgagccgagatgcccagaacatcatgttacattaagcgtgcaaactattagccaaatggttgataaagtgctgagtttgccggaagaaagtaagatgatgttacttgcaccggtggtcaaaaatcgtaaaggcgagcatattaaaattttagaaaatattgccgcacaaggctatattcgggcaaggattgatggtgaaatttgtgatttatcggatccgcctaaattagaattacagaaaaaacatacaattgaagtggtggttgatcgctttaaagtgcggtctgatttggctactcgtttggctgaatcttttgaaacagcgttagagttgtccggtgggacagcaatcgttgcggatatggagaattcgcaagtggaagaattgattttttccgctaattttgcttgccctcattgtggttattctatccctgaattagagccgaggttgttttcttttaataatcctgccggtgcttgttctacttgtgacggtttaggcgtgcaacaatattttgatgaaaaacgtgttgtacaaaacgcatcgatttctttagccggtggagcgataaaagggtgggatcggcgtaatttttattattaccaaatgttgatgtctttagctaagcactatgattttgatattgaactaccttttgaaaagttaccgaaaaaaattcagcaaattatcttaaacggttcaggtgacgaggaaattgaatttcaatatatgaacgatcgtggtgatgttgttcttcgccatcatagttttgaggggattctcaataatatggctcgccgttataaagaaaccgaatctatgtctgtacgagaggaattgtccaaaaatattagtagtcgaccttgtgtagattgttgcggttcgagattacgttcggaagctcgccatgtttatatcggtgaagctaatttacctgatgtatcagagaaaagtatcggagaagcactcaattttattgataacctgacattgacgggacaacgtggacaaattgcagacaaaattctgaaagagattaaagagcggttacaatttttagtgaatgtggggctgagttatttatctttatctcgttcagcggaaactttatccggtggagaagcacagcgtattcgtttggcaagtcaaattggtgcaggattagttggagtaatgtatgtacttgatgaaccctcaatcggtttacaccaacgagataatgagcgtttattaaatactttgttgcatttgcgtaatctaggcaacacagtgattgtggttgaacatgatgaagatgctatcatggcagctgatcatattattgatattggtcccggagccggtgtgcatggaggaaatgttgttgcacaaggtaatgcacaagaaattatggctaatccaaattctttaacaggtaacttcttgtcaggtaaggaaaaaattgaaattccgctgaaacgaaccgcagttgataagcaaaaaatgcttagattaaaaggagcaagcggtaataacctgaaacaggtgaatttggatattcccgttggtttatttacctgtataacaggtgtatccggttcgggaaaatctaccttaatcaatgatactttatttccattggctcaaaatgcgttaaatcgtgcggaaaattcccagtttgcaccttatcaatcaattgagggacttgagttttttgacaaagtgatcgatatagatcaaagtccgataggtagaacgcctcgttccaatcctgcaacctatacagggttatttacgccaattcgtgagttattttccggcgtgccggaggctcgagcgagaggttataatccggggagattcagttttaatgtgcgtggcggacgttgtgaagcctgtcaaggtgatggcgttatcaaggttgaaatgcactttttacctgatgtttatgtgccttgtgatcaatgtaaaggtaagcgttataatcgagaaacgttggaaattcgttacaaaggcaaaactatccatcaagtgcttgatatgacagtagaagaagcacgagtgttttttgatgctattccaatggtagctcgtaaattacaaacgttgattgatgttggtttatcctatattcgtttaggtcaatcttcgacaaccttgtccggcggagaggctcaaagagttaaattggcaacggaactttctaagcgagatacagggaagacgttatacattttagatgaaccgactacaggattacattttgccgatattaaacaactcctgaccgtcttacattgtttacgtgataagggaaataccatagtggtaattgaacataatctcgatgtaataaaaaccgctgactggatcgttgatttaggaccagaagggggaaatggcggaggacaaattattgctaccggcacgccggaagaggtttgcctagttgaaggatctcatacggcgagatttttaaaaactatgttggctaaaaaataacatcataaattagaaaccgtacttcatggattcgattttaataaagtgcggttttttctttgctttttataaaaaagttctgttacaaagggtgtttttttgctaaatttagcacaattttttcgttaagctcggtagagcgtttttatacaatttattagcggacttcttatgttattcaaaaaaattcgtggtttattttccaatgatctctcaatcgatcttggtacggcaaatacgttaatttatgtaaaaggtcaaggtattgttttggatgagccttcagttgttgcaattcgcaaggatagagcaggttcacttaaaagtattgcggcggtcggaaaagaggctaaattaatgttgggtcgtacgccaaaaagtattgaagctattcgtccaatgaaagatggcgtcattgctgatttttttgtcacagaaaaaatgttgcaatactttatcaaacaagttcacagtggcaattttatgcgaccgagtcctcgagtgttggtttgtgttcctgctggagcaacacaagtcgaacgtagagctattcgtgagtcagcaattggtgcgggagcgagagaggtttacttaattgaggagccaatggcagcagctattggtgcgaaattacccgtttcaacggcaacaggatcgatggttattgatattggtggtggtacaacagaagttgcagtgatttctttaaatggtattgtttattcttcttctgtgcgtattggtggtgatcgctttgatgaagctattatcgcttatgttcgccgcacttttggttcaattattggagaaccaacagcagaacgtattaaacaggaaataggtattgcttatattcaaaatgatgatgaagtgaaagaaatggaggttcatgggcataatttagcagagggagccccacgcacatttagcttaacttcaaaagatgttttagaagcattacaacaacctttaaatggcattgtgaccgctgtacgtacagcgttagaggaatgccaaccggaacatgcggcagatatttttgagcgtggtattgtattaacgggtggtggagctttattgcgtaatattgatgtattgctttcaaaagaaaccggtgttccggtaattgttgcagatgatccattaacttgtgtcgctagaggtggtggtgaggctttagatatgattgatatgcacggcggcgatattttcagtgatgaaatctagttttaacaacatgaaaagtgcggtagattttaccgcactttttgtcttaactatttaatctgttgtgataaatcaatctttatgaaacctattttcagtaaatcacctcctttaggtattcggcttattttagccgtggtagtttctatcactttaattctgtttgatggcaaaactagtgcaatgattaatcttcgtggttttatggaaactgcggtaggaagtttatattatttagccaatacgccacgtgttatactggacggtgtatcagaaaatttgatcgatacaaataaattgcaaatcgaaaataaagtattacgtgaacaattacgagaaaaaaatgctgatttgctcttgttggatcacttaaaagttgaaaatcagcgtttacgtttattgttaaattcgccactaagaacagatgaatataaaaaaattggtgaaattttaaccgctgaaacggatgtttatcgccaacaagttattatcaatcaaggtgcgaaagacggtgcttatgttggacagcctgttattgatgaaaaaggtgtggttggtcagattatttcagtgggggaaaatactagtcgagtattattattaactgatgtcatgcattctttacctgttcaagttttacgcaatgatgtacgtgtaattgccagtggaacagggcgaagtgatgaattgactttagagaatgtgccgagatcggtcgatattataaaaggtgatttgcttgttacgtctggacttggggggcgttttttagaaggttatcccgtcgcaattgtggaaaatatttctcgtgatagtaaaaattactttgccactattacagctaaacctttggcttctatagaacgtttacgctatattttactactttggccaacgcatgaagatatgcgtaaagcacaatctctgacacctgaagatgttcgtaaagcagtgcaacaacgtctagaaatgcagcataattcttctctatataaggtgaaaaagactccggtacaggaggaattttttccatctaataatacagatgagtattcagtagatatattagaaaccttaccggaaaatttacctgagcaagagtttctacaaaaagagcagggggatgaaaattaatgaaaataaaatttttgttacaaattttagtgattagcggtttgtttatttttacttttgctcttgaacttatgccttggccagtaacttttcagagtttcaaaccctcttggctagtgttggttttgctttattggattttagcgattccgaataaaatcagtattggtaccgcatttatattaggtattatttgggatctaattttgggctcgatattaggtgtgcatgctttggttttatctgtctttgcatatttgattgcaattaatcatttggttttaagaaatttatctttatggttccaaggtattcttactattttatttgttatcgctattcgtttttcaatttttttgatcgaattctttttaaatggtgtacattttaattggcaagcgatttttggagctatcacaagtgggatattatggccttggttatttttattattgcgtataattagacgaaaattagatttaagatagttttgttcttgcgaggattaagtaatcacatgccaataatcacacaatttccaatggagttgactttttctaaagttgtttttgttgtgttatgatctccaatgggaccaatgacaactctgttccagttttcactacgtttaattttagcatcgaaaccggcaatagataaacgtgcttgcatgttttctgcttgagcacgatttttaaaagccccacattgcaagccaaatttcttttccggcgaatttacagtagggttgttttgtatagactgtgctgtttgtaccggctttgcggacacaatatctattttctcacgtcttttatcttctttaattcttgcctgttcagccgctttttgctctttttccatttccagcaaaattttcttttgctcttcgcttaaacgaatatcgttatttaacgattgattattatcaataggaactgttcttgtttctagggctttaatgtaactccatacttcttccggtggggtagggaggacgcttttgggtttttcagattttacgggtacctgtatagttgtattcttcgttttggttttcaaaaaatacaacccagccacaaagccaataatgatcaaaagaatcaaggtaattaagaagattttatgctttccttttgtctgttttttctttttagacttcacacctgttccgtaatcttttgccacaataaaatcctgaataacgagtaagtaataaaaatggcaattctactcaaaaaactataactaatctagtactagctcaaatccagcggatctatatctaaaactaaccgcacttgttgtaatcttaaaaaattttcttgctgaaaagagtgtaaaatttgttgtaattctgctttggatttatgttgtaataaaaggtgccagcgatattgccccgcttttttgctaaaaggtgcttggataggccccaagatttgcaagtttttgcttgaggtattatgaaaataggctgcaatttggtgtaacacttcctcagctttttgtgagtggcgactttgggctttaaacagtgcttgagcactgaaaggcggtaaccccatttggttacgcaaagtgagggcttgttgggcaaagtaagggtaaccttgacttaataaactaaccaataaaggatgttccggatagtgggtttgcaagacgacctctccttgtttttcttctcgtccggctcgtcctgcaacttgaacataaagttgggctaaacgttcttctgcccgaaaatcagtagaaaaaagtgcactatccacgtttaacagtgccactaaagttacattggggaaatgatgccctttggctagcatttgtgtaccaattaaaatttggcttttgcctaattgaatatcccgtagatattgttccaattttccttttcgagcggtactatctctgtcaatacgggtaatcttatagtttggaaaacgttggtttaaactttcttccaattgttctgttcctaaacctgtcgtcactaaatgtgtcgaaccgcaatttacacattgcattggaataggtttttgtgttccgcaatggtggcaacgtagaactcgctgatgttgatgataagtataaggcttttcacaatattggcattctacaatccagccacattcatgacaaagtagaacaggtgcgaaaccacggcggtttaagaacaataaaacctgatttcccttttttaagtgatttttcatcattgtcaacaaggtttcagataaaccgttatgtactatttgtcgctttaggtcgataaccgaatgacgaagtgcggtagtatttcttgctctttttttgagtgtgatgtgacgatatttgccttgtcgcacattattgatgctttccaaacttggcgttgcagatcctaacacgataggaatatccaattgtttagcgtaaactactgcaagatcacgagcatgataacgccagttatcttgttgtttaaatgaaagatcatgttcttcatcaacgataattagccccagttgtttaaagggagtaaatagtgctgatctcgtgccgatgatgaccgcactttcgccatttttagaacgttgccatactttcaaacgttggttatcatttaaatttgaatgtaacacatcaatttcaatattaaatctcgcttgaaagcgttgtactgtttgtggcgtgagaccaatttccgataccagtactaaaatttgtttctcttgttgtaaaatttcctcaataaattgaagatagatttctgttttacctgaaccagttacgccttctaataaccaacagataaatccggattgaaagattaattggctgagtgcaagagcttgctcttggttaagggaaaggcgatcgttagtttttacaatagattgatgatttaatttttgttgccaagagatacttgttttatgtatttcttgttcagatatataccccttactttttaaggtgctccaaacttggttatgaaaaggattgttatttttttctgtgatattgttttgtagataatgtagagcctcaagctgtttttttgctctttttaatttgttattgtctaatgcttgttgcccctgttccgttagttgaaagaaaaatgttgatttttctaccgcactttcaccacggcgtaatttgcttggcaagctgcttattaatacttctcctaagggaaattgataatagtccgctccccaatgtagtagacgccataattcaggggtaaaaacagaatgatgatcaagaacggagataatgggtttgagttgtgaaatatctatctccgttttttcaggtaactcagtgacaataccaattaatttttgtcgtccgaaagggactaatactcgacagccgataggggttgaaagggcatttggaataagataatcaaaaaaactaaacagaggaacggcaagagcaactcgtgcaagtttcattatgttattttccttacgtagtttgtgtgatttcatctcgtttaacttcatcccaaaaaatatccatttcagttaaagaggtattttcgaaggttttgtgtgcttcacgcaatttttgctcgacagcacgaaaacggcgttcaaattttttattggctttacgcaagctttcttcaggattacattttagatgacgacttaaatttactaccgcaaaaagaagatcgccgatttcttcttcaatttttgtttggttgataggatttgtttgatattcctgtttaacttcttctaattcctcttgtactttagctatcacaggattgacattattccagtcaaaacctattttggcacagcgtttttgtaatttttcggcacgcttcaatgccggaaaagcatggggaatattatctaagattgattgatgtcctttttgaatatattcacttgcttttgctttgttccaattttctaatgcctcgtctgcattattggctttttgttctccgaatacgtgtgggtggcgacgcaagattttttctgtaacggtatgtactacgtcatcaaaagtaaaatattgatcttccgtagcaagttggctaaaaaatacaacttgtaagagcaaatcacctaattcttctttcagatcagacatgttattttgctctattgcttcaatgacctcataagtttcttcaattaaacaagtgatcatcgaacgataattttgctttaaatcccaaggacaaccattattaggatctcgtaattgggcaatgatacgaataaaatcttgaatgtggtagctcataaataatctcatgaaataaatagtatttgaaataaggatatcatagccttgaatgaacaaaaaaatgaaaaattttttaaatttttagccacactgtcccaggaaatgacgatgaactatcatttgataaatatattgggtcgatgagtgcctctattatgtgatgagtgcaccaagactgacaagcatttttttgaatcaaatattaaaaaattatgctcatttctaaaaaaacattttgacatcttgatgtttttagtttgcaagaaaaaagccatagattaacgaggtatttggtttatggagctgacttttattttttattttattcacataaggaaggtattatgttaaagaaattagacccaagtaaagttgttggacttaaaaaccaatcgaactgcaaaacaattatgacaattggtgttcaagacaagaaataactccagttgagaagacactaggttgcaatctagtgtctttttttattaattagattttaaggataatgaatgaactttaattatatttataatccaaaccagtctttggcgattgcgttgcatagtgcaaataaccaaaagattgtagattctttttattatttattggatgtctgtgatgaaatcttggatgtaaactccaaagaaaatataataaaaggcatagattttataaaatccaattcgatattgagaggtattttatttcactttgtcaatcatcttgttaagtcaatttctaaaaatgatattgatgaaataaaagatgtatttacttattttaataattttatcttattttatagccgagaaaaaataattttttctggtgtaggaaatataggtaacttatatctaaatcagtttaataaaattaatgatgatgcctatgagttttcttgtgcacctatcaaggataatttaattaatgaatataggttaaaaattaataatcttatgaaatttatcagagatattgatttagaaacctatatggaaattgagaatatagtcgatgatatatatgtatttggtgtgaattttaaagatagtcaagaaatgatttattctggtagtgattttgacaaacttggttgtattttctttaatgaagatatttttttagataaagatgatttgtttatcttggataagattatacatgaatccgctcatcagatattattgtctgtaatgatacatgatgaagttgtgctaaattcagatgatgagcgttatccatcacctcttagaaccggactaagaacaatgaatggtatatatcatgcagcttttgttttgtatcggatagcaagatcaagattttttaatcaaattattgagagaaaaaatactcaatatccttataatcatttgatttcttattttaacaaaaataaagaacaatttttggtttgttatgatgttatttctaaaaatggaaaattaacagatttaggaaacgttatcatcgaaaactattataaagaattaaggagtatgtctagtgaaattgacagataagctatctaaaaaaaccattgaattgatgcaaagatttaatgataatgcggtaagaagactaaatgatgatttatatccaatagcaccagatttggtcgaaatgcttattgattcaatttacggtaatgtttatcaaagaggtgttttgagtattaaagaaagacatatagcaacgctatcggcacttattgccattgggggctcagaaaggcaattgtcgtttcaagggtttgctgcttataagcttggtatcacaaaagaagaaatccaagaaatattgatacaaaatgcaatatttagtggatttacgagagcgatgaatgcggctgttgtgcttgatgaagtgtataagaaatatttacaagggaaagatgatgaagcttaatgatttttatcgttatcaattagcagaagttatgcttaatactggcataagaactattggatttttgtttgcttggcttatgctcactacctttcatcaacctcagcatttaggtgtttttattggtatttcttgggcgtgtcaggtgttggcattgcttttattttcttgggtgtgcaaccagtctacatttattatttatagtaaaaagttattgttgcctttttgctttatttgttttttgttttttttgacattgttttttgtttataattattttatttttggcatagtttttatcgttagttctgtttttaccattctcttgaatccattggggacgagtcttaccaatgatttgtatgatggtgaagataaatcaaatggatttaaattgcgtggttttgtgaattctattaataccattatttcccctgctatttccggatttattattcactattttaatacacagaagattattgttttttgtatcctattatctttattaagtggtttcttattttattttataaaaaatataaaattacaagaaaacttgggaaaaaaatctaaaaacacccttaaaatactattgaaaaaccctattgaaaaattgatggtttgtgtatcattattagctaattttattatcactcctattatttcatatattattccttacaatatatccaacaaatttaatttatcggcattttatatcggtattagtgaggctttctttggtatcggtatgataataggtagtgtttattttctaaaattgtttaataaaaaacttggcagtcatcatagtttggtattaagtattttcttggtgatgataggtattttgttttctgtgacagataatttttatattttttgtttttctttaatgacgattggggttggtgttgtgatgtttaatattaacagtacacatattcgctgtacggcaactcccaaaaatattcgtaccagttttgaatttgtttttttagcgtgctgtattgtatttattccaattggcgtattgttaacgacttgggtattaaataatggagctttggtttatttttatggaattatttgtttgattatgttggttttgtctttaatgatttttaaaaatactgatattgttcacattcatcagcttactgatgataagctagatggttattatcaggttttgtatcccaaaatttatccataggtgtgggtgttgtggtatttggattgtggcactgccctagcaggggcggaggtagagtatcaagacaaacaagtgatcatcgaacgataattttgctttaaatcccaaggacaaccattattaggatctcgtaattgggcaatgatacgaataaaatcttgaatgtggtagttcataaataatctcatgaaataaatagtatttgaaataaggatatcatagccttgaatgaacaaaaaaatgaaaaattttttaaaacgtgatctggtgcaaatttttttatttttatcaatgctagtatagttccaacagttagttaaattcattaagctaaggaggcaattatgtataaacacgtattagtggctgtagatctttcagatgaaagtggatttttactcgaaaaggcagcaaaaatagcgaaacaatatggtgctaaattatcggttatccatgttgatgtgaatttttcagatctttatacgggtttaattgatgttaatatgtcttcaatccaagatagaatttcaactgaaacacatcaagccttgattgagttatcagaacaatctacctatcctgtttctgagaaattgagtggtagtggtgatttaggacaagtcttatctgatgctgttgagcaatatcaggttgatttattagtaacaggtcatcatcaagatttttggagtaagttaatgtcttccactcgccaagtgatgaattcaattaaagttgatatgttagttgtaccgcttagagaagaataaatataaagaatttgtgatgggcagcgtgagttgcccttttttattagcattgaaatattgttttgcataatgcgttattacttcttgagagaatatgaataatcagctaaaaaagttttttataaatgtcaaaaatatgcaacaataagcaggttttttactggatttacaagatataacaaggttttttaatgaaaacaacagcagaaattagacaggcttttttggattttttccatagcaagggacatcaaattgtagatagcagctctcttgtaccggaaaatgatccaacgttactttttactaatgcgggaatgaatcaatttaaggatgtttttcttggattggatacccgttcttatacgagagcaactacagcacagcgttgtgtacgtgcaggcggtaaacataatgacttagaaaatgtcggttataccgctcgtcatcatactttttttgaaatgcttggtaattttagttttggagattatttcaaacaagatgctattaaatttgcttgggaatttttaacttcaccagaatggctcggattaccaaaagaaaaactatatgttactgtttatgaaactgatgatgaggcctatggtatttggcataaaggagttggtgtgccggaaaatcatattattcgcattggtgataataaaggtgccccttatgcttctgataacttttgggcgatgggtgatacaggaccttgcggtccttgcactgaaattttttacgatcatggtgagcatgtgtggggcggtttaccaggtagtgaggaagaagatggtgatcgttatattgaggtttggaatattgtatttatgcaattcaatcgattggctgacggcacgatggaaaaattaccaaaaccttccgttgatacggggatggggttagaacgcattagtgcggtaatacagcatgtaaattcaaactatgatattgatattttccaaaaattaattgctaaggttgcagaactgacaggggaaaaagatttaactaacaaatcgttgcgtgttatagctgatcatattcgttcttgtgcctatttaattgcagatggcgttattccttctaatgaaggacgtggatatgttttacgtcgcattatccgtcgtgcggttcgtcacgggcatttattaggtgctaaagacactttcttttataagctcgtaccggttttgatcgatgttatggctacagctggtagagatgtaaaagcgaagcaagccaatgtagagaaactgctacgattagaggaagagcaatttgctcgtactttagaacgtggtttagccttgttagatgaggctttaattagcgtaaaagatggtgtgttatccggtgaagtagcatttaaattatatgatacttacggttttccattagatttaactgccgatgtttgccgtgagcgtaatattcgtattgatgaggaaggcttcgagcgtgaaatggaagtgcaacgcttgcgtgcacaggcggcaagccgatttggtgtagattacaataatgttattcgtgtagaagggacaactacttttgaaggttatactgaggctgaaactcaggcaaaagttaccgcacttttctatgaaggcaaatccgttgagagtattagtgcagggcaaagtgcggttgttattttagatgatacaccgttttatgctgagtccggcggacaaataggtgatagaggttgcctgattgcgacaaatatgcggtttgacgtgaaagatacgcaaaaatatgggcaagtttttggtcatatcggtacgttaattcaaggcacattaaacgttggtcaaacaatcaatgctgttgttgatacggaacatcgtacaaaaacttcattaaatcatagtgctacacatttattacatgcggctttacgtcaagtattaggtactcatgttgcacaaaaaggctctctcgtatcagatactatattacgttttgactttgctcaacctgaagcaattagccaagaacaattgtttgaaattgaatgcctcgtaaatcagcatattcgagctaatcatttggtagtaaccgaagttatgcctattgatgaagcgaaagctaagggggctatggcattatttggtgaaaaatatggtgatgtagtgcgtgttgtgaaaatgggcgagttttctattgagctttgtggcggtattcatgtaaaacgtacgggtgaaattggtctatttaagattgtttccgaatctgctattgcggccggagttcgacgtgttgaggcagtaactggagaggttgcaattaattggttgcaacaacagcaacagatcttaatgcaaagtgcggatcttttgaagtctgatgcaaattcattagtcgaaaaaattcagcaattacaagataaagcgaagaaaacagaaaaagagttgcaagcactaaaagaaaaatctgcgatgaaggcgggttctgatattgctaaaagtgcggtagaaattaatggtgtttctgttattgttcaacagcttgaaaatatggatgtaaaatctttacgtgttattgtcgatgatttgaaaaatcagttgggatcagcggtaattgcttttgttacgaagaacgaagataaggttaatctagttgttggcgtgacaacggatttaacctctaaagttaaagcaggcgaattagttaatttaatggcacagcaagtgggtggtaaaggtggcggacgtcctgatatggcaatggcgggtggatcacagccggaaaatatctccaaggcgttaacagtttgtaacgaatggttacataaaaatttataaaataaaaattttgtgttgtggctcacatttttgaatattattcatctctttgtgggaataaataacgtacaatgtaagtcggataacacttcattattatcatgctttattattataacgctttgttatttaaggattttaagcaagatagagatcttataaattcaactgaaatgagagggttatatgctgatattgaccagaaaagttggcgagagcttactcattggcgacgatatttctatcacaatattaaatatacgtggcaatcaagtaaaaatcggtgttgaagcaccgaaagaggtttctgttcatagagaagaaatttatcatcgtattagagatgttaaagatgaacagcagttgtaattggctttttgaacgataagatatggagaaattatgagtaaactaacttgttttaaagcatatgatattcgaggtcgtttgggtgatgaattgaacgtggatattgtatatcgtattggtcgtgcatttggacaatttttaaaacccaaaacgattgttgtcggtggtgatgttcgtttaacaagtaaagaattaaaaagtgctgtaacaaatggtcttttggactcaggtgttaatgttattgatttgggagagacgggcactgaagaggtctattttgcgacttcattcttaaaagctgatggtggtattgaagtaacagccagtcataatcctatggattacaatggattgaaacttgtacgtgaaggttcgcgtccgattagtgcagatacaggtcttgcagatattcaacgtcttgcggaagaaaataattttgctccagtttcccaacgtggggagtataaacaactttcagtattagggcattatattgagcatctcttatcttacattaatttggaaaatttaaagccaatgaaattggtgattaattcaggcaatggtgcagcaggtcatgttattgatgctattgaagcacaattccgagctaagcatgtgcctgttgaatttgtgaaagttcacaataatccggatggtactttcccgaatggaattcctaatccgattctgcatgaaaaccgtcaagatacgattgatgccgtgttagagcataaagctgatatggggattgcttttgatggcgactttgaccgctgtttcctatttgatgaagagggcggttttattgaaggttattatattgtgggattattggcacaagcatttttacagaaaaataaaggggctaagataatttatgatccacgcttaatttggaatacgattaagttagttgaagataatggcggcgaagcggttatgtctaaatccggacattctttcatcaaagaaaaaatgcgtgctgttgatgctatctatgggggcgaaatgagtgcacaccattatttccgtgattttttctattgtgatagcggaatgattccttggttgcttgttatggagttagtgtcaaccacaggtaaatcactaggtgagttagttgggaatagtcttgaaacctatccatcaccgggtgaaattaacagtaagttagttgatgcgaagtctgcaatagagcgtgtgcgtgttgcttatgaaaaagaggcagtcagtgtagatgaaactgatggtatcagcattgagtatccaaattggcgttttaatttacgcagttcaaatacggagccggttgttcgtttgaatttagaaacacgaggcgataaacaattgatgacagaaaaaacagaagaaattctcgctttattgcgtcaataaattaaacttaagtaagaccgcactttgtttccgcaaagtgcggttatttatggctctaattaaggaaattaaaatgaaagtaattattcctgttgctggcttaggaacgcgtatgttgcctgcaactaaagcaattcccaaggaaatgttaacgttggttgacaaaccgttaattcagtatgtcgttaatgaatgtgttaatgcagggattaaagagattgtgctggtaacgcattcttccaaaaatgccatagaaaatcattttgatacatcttttgagttagaaacaatgttggaacagcgtgttaaacgccagcttttagatgaagttcgttctatttgtccgacaggcgttactattatgcatgttcgtcaagggaatgctaagggactagggcatgctgtactttgcggtcgggcaattgttggcaaggaagcttttgccgttgttttacctgatgtattacttgctgaatttgatagtaatcaaaaaacagaaaatcttgctgcaatgctgaagcgttttaaagaaacgggaaatagtcagataatggtttcacctgtacctgataaagatattagcagttatggtattgttgattgtggcggtgttactttaaatattggtgagagtgttaaaatctcaaatattattgagaaaccctcatttgaggacgcaccttccaatttgtctgttgttgggcgttatgttttttcagcgacaatttgggatctattggaaaaaacgccagttggtgtcggtaatgaaatccaattgactgatgctatcggtatgctaattgaaaaagaaattgttgaagcatttcatatgaccggcaaggcttttgattgtggagataaaataggatatatgcaagcttttgtggaatatggtttacaacactctcaattaggggagaattttaaaacctatttgaaacaactggtgcaggacttgtagaaattcgttatggctaaactttgtcggttctttaatataaaattttattaagggaccgattttttgtgattaaaaactgctatcaattcatttactttaattcttttgtgagatgatttgctaatagaacgctgaacttttaagcgtttaatttttgcgtctttgtagatctctctagtaaatttggtatcgtggttagagattaagaccggtacatcgtggtttagtgcggtatcttttgccagttgagctaaattttgttgatgagataaagaaaattcattgcctgagtagctggtaaagtttgagttttgtttcaatggtgcataaggtggatcacaataaataacagaatcattattgatcattgaaaatgcttgttggaaatcagcacaaataaacaccgctctttgtgctttttgggcaaaataacgtagttcagactccggaaaataatgtgttttataactaccgaatggaacattaaattcatttttagcattatatctgcataatccgttgaaaccatatctatttaagtacaaaaacaaaaccgcacgttcaaaaatattttgcgataaattaaattcagctctgcgatggtaataataattagcggtattagcttgatcatggaaaaatattggtttgcatgccgcaatataatgttcaacatcttgttttacaatattaaatagatggatcaagtcagggttaatatctacgagaatatagtgttcaaaatgagtatttaagaatacagaaccagcaccgacgaaaggctcaataaggcaagttttatttttaggtaaaagtttgttaatttcctctgttaagcgaaacttaccgcctgcccattttaaaaatgggcgatatttcactaaattagaagaagttcctttgctggacatgaaagattaacttttttttgaacaggtacgaattgcatcaagcacgtattctttgtccgtatctgttgcaacgtaggcttgaccaagtgattttagtaagactaggcgtaattttccagcaagaacctttttatcacgcatcatatgtggtagataatcttcagctttcattgtatcaggtgaggctgtaggtaaatctgcttgagttaaaagtttctccagtctcgttacatcgttaagtgataaatcacctaattgattagacaagacggcagctatcatcattccggttgcgactgcttctccatgcaaccaatttccatatccaaggtgagtttcgatagcatgcccgaaagtatgacctaaatttaataacgcacgctctcctttttcagtttcatcacgagtaaccacatctgctttaatttgacaacagcgagcaatgcactgctgtaaatattgttgttctaaagcaactaaattagttatatgtttttctagccatgtaaaaaattcatcatctaaaatagcaccatatttaatgacttcagctaaacctgcgtgaatttcccttttaggtaaagtagttagcgttagcgtatcaataataacggcacaaggttgataaaaagcaccgatcatgttttttcctaatttgtgattgacagccgtttttcccccaacggaagaatctacttgagcaagtaatgtggttggaatttgaataaaacggacaccacgttgatagcttgccgctgcatatccggcaatatcaccgatcacaccgccacccagtgcaataatagaggtatctcgtccatgattagcttttaaaagtgcggtaaaaattaagtctagagattctaaagttttgtattgttcaccttctgggagttgcacattctctaccgagcaaccaattttttctaaggtgtctgttacagaggataaataatactgtgcaattgtagggttagttacaatcatcaccttatcgcctttttttagcggataaacttgtggttcggataataaccccattccgatatggataggataactacgttcccttagttctacattcacacacagcattttatacctcaaaatgtaattagattttaatattatcaattaaatcaatgatttgattcgccattaatttggcactttgctcgtctgtcggcaaaataatatcagccacttcttcatataaagggttgcggactttggctaaatcttctaatacttggcgaggatcttcaacattttgtagtaatggacgttttttatcacgttgagtacgttggaattgtttttcaacggtcgtttctaaataaataacggtgccacgagcagataaataattacgattatcttttgatacgattgcaccaccaccagtagaaagcacaatgccttgtttttgagttagttcattgatgatacgttcttcgcgtttacgaaaaccttcttcaccctcaacgtcaaaaatccagctaatatctgcacctgcacgttgttcaatttcggcatcagtatcaataaattccatgcctaaaatttgtgctaattgacgaccgattgtactttttccagcccccataggacccactaaaaaaatattacgtttttctgccatttgtacttcttctttacaaataaaattaaaaaattgatcttataaaaaacaaacgacctaaaataaagaggtcgtaaaagatcgcccaaaaataatggagattatctcaataaatgcccccttttttcaacctaaaaggggatttattttaagatttcattaagtgcggtttattttaatactattttaatggttttattatttcatcaggttgttctgaacgaatgatccttggggtaacaaaaattactaattcacgtttttggtgtctttcactttcacggctgaacagtctttttaatataggtatatctcctaacaacggtactttatctactccttttgtgattgtatcgtgaaatacgccacccaacacaatcgtttccccatctcgtgcaaaaacttgagtattaatttcttgtttatcaatagataccatttcattttgcccataagtaatacgacttccaggggagttttggcttacaatgagatccagtaaaatagtattgtctttagaaatgtgtggcgttacttctaatcctaaaactgcttctctaaactctactttctgttcatcagatttcttgccggtaataacataaggaatttcagttccttgtttaatacttgcactttgcttattcgttgtaagtaaacgagggcttgcaataatttccacattattttctcgttcaagtgcggtaagttctaagtctaaaagtcgatcattaattttggcaatttgtaaagcaatagaacctgcaggtgttgcggtagtagcaaaattgacgttaagttgttccgttaaatgctgaaatccgtttgctgctagattgcctgaaagatgatgagcgttatttgtaggctcaaaaattccccaacgaacccccaattcttttaaattttcatcgctaattgttacaattctcgcttcaattgcaatttgttcaataggttgatccatttctttgattaatttttttaaggcattgagagtttcctgattatcctgaattaagagcaagttacttcgttcatcaaaactaaaagttccatttgatgaaagccatgaaccttgacctgtagtcagtgatttcattacatcagccgctttagcataatgtaatttgatcgaagtcgtcgttaaatttggctcattagtcgattttgacaaattttcctttgtatctaattgtatatttgtctctttttttatgcttctttgtcttttatcaaagggatctctagcagataattccacacttactgtgaataagaacaaaaagaaatataagaaatttttaattaacataggtattctccatgactaaagttgtaaagaaatatcggcttgaatggaaaaatcttcattttcactatgagaaatttgcaacgaaactaaattgagtggaacttgaggtaaaagtgcggttaaaaattgagataaatcggaaaaatagcctttaacgtgaaaagttaaaataggttgatttcccatttgccaatgagattgttcaaataataattttccattatttaacaattgtaatttttgattaatttgtgcaagaggtttattaaactcaatattattttgttgatagcgttcctttaagctggttaatatttgttgcctgtgaacaagtcgagcatttttttcgtcaatttcaacttgaagtttgtgtgcaatttcttgttgctgaatataattgagcgagggataaattgagcttatcaaaattattaagaaaaaaattaaaatttgttttagtgaagataaatttacccattttactaacaaattatcagaatgctgtaacttcatgatctattccttatgttgagttaaacttaattcaaattcaaatatgactgatcttctctgatcaatttgttgttctttaaatgtcaacagttttacacttgaaaacaaattttgttgtttcaagaatttttgtagctgttcaacttcattatttttctccgtttcaccttgcaaaattaatttttcaaaatctaaggacagctcgtttaattccccactttgtaacggaagtttagaaattgttgttaatattgataaaaattgttcattcggtaatttttttaagttttttgatttaccgccataatttctttgtaatgtagaaatgttctgttttatttctgcaagtttattgtcaatttgttgtatttgctctctttttttatctatttcggtgtcaattttttgagttaaataaagtataaaagtcacaccagcaagacagataatgaggctggcaagtgatttataaataaacgattttattttttgtcgataaatttcttgtcgccaaggtaataaattaatttcaatattacgcatttattattcctttaattccgttatttgatagagttcatgtcttccccaaagagcatttcctaaagcaataaaaggcaattcggtattaatgatgttccatttatgagtgatattttgttgttcatttttttcacaatagcaccaaacgtgttgaggttggcagttaaaacgttggcagaattcttgataaagtgcggtaatatttttgtcatttttttgtagaacgattgtttgttgtccgatttcttgtattgctatacagccgttacgatcctgatataaatataatgtttccatcttttctttttgggggtgaaaataatggaatgctcgtagtaggctattacttaagcaatctaacgtattaatttttatagggaaaaaacgatgcacataattttgagctgtttgttttctaacaacgtagatagccagttttgcaccttgtgttaattctttatattggtagtcgtaccaaatatcaccgaaatctgtcggcaattcattttctatgattaagttacattgttgttggcattcttgctcatttaacttttgcgtcaatatgattgtttttacccagacgtgctgattgggtaaacaggctatccatgtgcagatattctttgcgaattgtggtgtcaaatcagatagtttaagagggggattatcgtttttagttaaaaagtgcggttgtttttgttcatcaaaccagaggaattgccattgttcatcttgtctatgaataccaatttgtaaaatatttgctgtttttttgttaggtctcatttcatattctctttaataaaatttatattttaaaacttagctttattagctaaatcctttatacttacctcattgattatcgatatatttttttcaaatacattaaataagagagaattttacgatgaggatcgcaaaattaatatttagtaccttactaacgttgattattttagggtgtgttgtagtcggtattttttacattcagataaagaaagatttgcccagtgttgatggtttaaaaacagttgagttacaacaacccatgcaaatttatactgctgatggaaaattgattggtgaagtaggggagcagcggcgtattccagttaaattgcaggatattccacaaaaattaattgaggctgtattggccacggaagataatcgtttttatgaacatcatggattagatcctattggtattgctcgagctattagtgtagctatcagcaaaggaaatgcttctcagggagcaagcacgatcactcagcaattagcacgcaattttttcttaacaccggaaaaaaatcttgtccgtaaaattaaagaggcaattttagccattgaaattgagcatgttttaactaaggatgaaattttagagctttacttaaataaaatttatttcggttaccgtgcttatggcgttgcggtagcggcaaaaacctatttcggtaaagaattatcgcagttaactttatctgaaatggctgtcattgccggattgcctaaagcaccttcaacaatgaatccaatcagttcattaaaacgtgcacaggatagacgtaatgttgtattggggcgtatgcttgagacgaactatatttctaaagctgaatatgatgcggcgataagcgaacctattgttgcctcttatcatggaacacagttagaatttcgagctgattatgtgagtgaaatggtccgtcaagaaatggtaagacgctttggcgaagaacaggcttatacgaaaggatataaggtattcacaacaattttatccaaagatcaggcacaagcacagaaggctttacgtgagaaccttattgcttatgacatacgacatggttatcgtggtgcggtcactttatggaagaaaaatgaaaaggcttgggaaacagaggcgattgtagcacatctaaaatctttaccaaattccaatccatttattcctgctgctgttctgtccataagtaaaacgggagctaacttgttgttagcggatggtaagaatattactttatctaacaatgcgatgcgttgggcgggtaaaaaaatgcctaaagaaggtgatcaaatttgggtaagacagcagaataaagaatgggttttagggcaaattccggaagctaattctgcattagtttctcttaatagtgataatggggctattgaagcgttagttggcggttttagttttgagcaaagtaaatttaatcgtgccacacaatccttggtgcaagttggctcatccattaaacctttcatttacgctgctgccttggagaaaggattaactttatcaagtgttttattggattcggaaattgttattcaaaaaccggggcaagaaccttggacacctaaaaattcaccaaatcgatatgatggtccaactcgattacgtgtaggattaggattatcaaaaaatatgatcgctattcgtgcgatccaaatggcaggtgttgatttcagtgccgagtttttgcaacgttttggttttaagtcggaaaatatttttgccagtgaagcgatggcattaggtgcagcctcttttactccgttggagatggcaagggcttacgcagtatttgataatggcggttttttagttgatccgtatttaattgaaaaaattcaagataatatggggaatgatgtatttattgcgaaccctaaaatagcttgtatcacttgtcatgatattccggtaatttatggagaaacagagaaattagacggatttaaagagaatacatctatatcggataatgccaatgccttagatttagggggggaggaagtcagtgaaattactgatatacccgaattaaatacggttaataaaaaattagatgaaagtgcggttctctttatggctgaggcgaagacggagcattcgacggaacaatatgcacctcgtgtgatcagtggtgaattggcttttcttattcgtagtgcattaaccagtgcggtctttggtgaagaaggacttgattggaaaggaaccagttggcgaatggcagagcacttcaagcgtcgtgatattggcggaaaaacgggtacaaccaataattctaaggttgcatggtatgcgggatttggtgcaaatctagccactgtggtatatgtcggatttgatgataataaaaggagtttaggaagaggagaaacaggctcggcaacagctatgcctgcatggatttcctatatgaaattcagtttaaacgatattccggaaagaaaacttgccttaccgccaaatatagtggaaaaaaatattgatgttagatccggtttattggcagaaacgggagaagggaaaatagaatactttattagaggtacggaacctaaaagaacattcgttcaacaaggacgtggttactaccttccttctgaaacggatctgccaagtgcggaaccggaagaaattttctaaaacaaaccgcactttgtaaaagtgcggtctatctttcattattttataaggctaagtttatgctaagttatcgtcacagttttcacgcaggtaatcatgctgacgtgttgaaacatattgttttaatgttgattattgaaaatttaaaattaaaagaaaaaggattttattatttagatacacactctggtgtcgggcgttatcgtttattcggtgatgaagcggaaaaaacagcggaatatcgagaggggattgctcgactttgggcaaaagaggatttacccgaggtaattcaacgttatatttctttaattaaaaagctgaattacggtggtaaagaattacgttattatgcaggttcgcccctgattgccgcacaacttttacgctcacaagatcgtgcattgttaacggagttacatccggcagattatcctttgttacgcaatgaatttaaggaaatcaataacattaatacaaagcgggataacggttttcagcagttgaaagcgactttaccgcctaaagaacgtcgaggtttgatcttaattgatccaccttatgaactaaaagaagattatgatcttgtggtaaaagcaattgaagagggatataaacgttttgcaactggtatttacgccctttggtatcctgttgtattacgacaacaaactaaacgaatcatcaagggcttggaaaatagcgacattcgtaaaattttgcagattgaattagcggtacgtccggactccgaacaacgaggaatgactgcaagtggcatgattgtgattaatccgccatggacattagaagatcaaatgaaaaaaatcttgccttatttgacccgcactttagtaccagaaggaaccggtaattggtctgtaaaatggattacgccggaatagaaaataccaatcaaattaatttattcaggcatttggtttttttggcaaatttttagcagaatacataaacttaaatataggagagaaaaatgactaaacattatgattatattgctattggtggtggtagtggcggtattgcttcaattaaccgtgctgcaagttatggtaaaaaatgtgcaattattgaagcaaaatatttgggcggtacttgtgtgaatgtcgggtgtgtgccgaaaaaagtcatgttttatggtgcacaagttgctgaagctattacaaaatatgcacctgattatggttttgatgttacgttaaatcattttgattttgccaaattggttgaaagtcgtcaggcttatatcgatcgtattcatacttcgtacaacaatgtgcttgcaaagaataatgttgatgtattaagtggatttgctaaattttttgatgcaaaaaccattgaagtgagttatgcaaacggcgaaaaagagctggttacagcggatcatattttaattgctaccggaggacgtccgagtcgtccgacaattccaggagcagaatatggtattgattctgatggtttttttgcgttgaccgaattaccaaaacgtattgcggtagttggtgcgggttacattgccgttgaattggcgggcgttgttaatagtttaggtgcggaaactcatttatttgttcgtcggcaaacgccaattcgtagctttgatccgctgattattgaaactcttgtcgaagtaatgaaacaagatggtattcaattacatacgcaagctattccacaagaaattatcaaaaatgcggataattctctaacaattaaattagaagatgggagaacgcaggacgtagattgtttaatttgggcaatcggtcgggaacctgccactgatgtgattaatttggcttcaaccggtgtagaaactaacgaacgtggatttatcaaggtagataaatatcaaaatacgaatgttgaaggtatttatgccgtcggtgatattattgagggaggaattgaattaacgccggttgcggttgcggcaggtcgtcgcttatctgagcgtttatttaataataaaccggatgagcatttagattaccatcttgttccgacggtagtatttagtcatccaacgataggaactgttggtttgactgagcctaaagctattgaacaatacggtgcggaagcagtgaaagtttatacatcttcttttacaccaatgtatagtgcggtgacttcacaccgtcagccttgccgtatgaagctggtttgtgttggtaaagaagaaaaaattgtcggtttacacgctataggttttggtgtcgatgagatgattcaaggttttgccgtagcgattaaaatgggggcaactaaagcggactttgataatactgtcgctattcacccgacaggctcggaagaatttgtcactatgcgttgataaaagtgcggtattaattaatgaaaaaaggattgttctctaccttagaggtcaatccttttaatagcgtatcttgatttagaaagatattctcgacctttcaaatgattagacataaaaaaaataactgttatactgatcaacgagtggagaattcggtttatcttcaatctatctcctataattagtataagaaggaaaagaaaatggcaaaaggacaatcactacaagatccttatttaaacgcattacgtcgtgaacgtattcctgtatcaatctacttagttaatggcatcaaacttcagggtcaaatcgaatctttcgaccaatttgttattttattgaaaaatacagttaaccaaatggtgtataaacacgcaatttcaacagtcgttccggctcgttcagtttctcatcataatagtgttcagcatcaccatattgttcaaactcaagaaatgcaagcggaagcattagctgaaaatcaaactgaataattttgaatacaaacaagcaattcaaagtatataccgcaagtgcggttgattttgcccaagatcctaccgcactttcttccaacataaatgtgcctcaatttgacaaagcaattgtggttcatgttttcttttctcaaaataaaaatctagaggatttacaggaattccaacttttggttaaatcagcaaatgttgatattctttcaataatcacaacctcacgctccacgccacaagctaaatattttgttggacaagggaaggcagaggaaattgctcaagctgttgaacaactcaatgcggatattgtgttagttaatcatagcttaacacctgcacagactcgtaatttagaaagtatctgtcaatgtcgtgttgtcgatagaacaggattgattttagatatttttgctcaaagagcgaggtcgcatgaaggaaaattacaagttgaattagcacaactcagacaccttgcaactcgtttagtccgccgaaaaacaggattagatcaacaaaaaggtgcggttggattgcgtgggccgggtgaaacacaattggaaacagatcgccgtttaatcaaagttcgcattactcaattacaaaatcgcttagaaaaagtagcaaaacacagaaatcaaaatcgtcaaactcgccgaaaagctgatattccgacaatttcccttgtcggttatacgaatgcaggaaaatccactctatttaatgtgctaactcaagctaatgtttatgtggcagatcaattatttgcaactctagatcccactttaaaacgtttaccaattcaagatgtagggaactgtgttcttgctgatactgttggatttattcgtgagttgcctcatgacttggtttctgcgtttaaatcaacattacaagaaactactgaagcaagtttattgcttcatgttattgatgtcgcagatagccgtaaattagaaaatatgttgacggttaatgaagttttaagtgagattaaagcaaaccaagttacaacacttttagtgtataacaaaattgatcaagtcgagaatattcaacctcatattgaatttgatgaagaaaatcaaccgattgctgtttatctttctgcacaattaaatcaaggtttggatttattagttgaggctattcgacaaaaattaagccacgaaattctacatttagagatcaatcttgctgcacaatacggtaaaattcggcattgtttttatcagcttaattgtgttcggcaagagaaaatcaatgaacaaggtgaattcttacttgatgttcaaattgataaaattgaatggcttaaattaagtaagcaatttccgctattgaaacgtttttatgaatcaacagaaatcagcgacaaataaaccgcactttttaagtctatttgacaattccgtattgttttaatttattggcaatggctgtatgcgacatccctaaacgggctgccaacttacggctacttggatattgctcataaaatttttgtaacaccattgactcgaacttattcattatttgttctaaggtttcaccggcaaattgatcaacattaaccggcaaaatttcttgctctgataagtttaaatcagcaattgccaactcattatttttggctaatgagcaagctcgatataaggcattatataattcacgcacatttccagcccaagtataatttttcagatattgaataaaccgctcattaaagtgcggtactgaaatagaaagtttttcactaatttgacgaataaatatttctgtgagaggctcaatatcttctactctttcacgcaacggtggaatagtcaaacttaaaacatttagacgatgaaacaaatcttcacgcattttaccttgttcaacatagtgttgtagcggaatttgcgatgtgcaaattactcttacatttgcacaatgttctttttcctcgccaacacgacgaaaagtaccatcgtttaaaaaacgcaacagttttgcttgtagctctaaagaaagttcagcaataccatctaataataccgtccctctattggcatattcaaaaaagcctgttgtttcaattcccttatccaaacgaccgaacatttcactttctgcatcttcagcaggtagccccgcacaatttatggcaataaacaagtgatccttacgaggaccggcattatgactggcttttgcaattaagtctttccctgttccggtttctccttgaatgagtaaaggtgcgtccaatccggcaaaagcttttgctgtttcaattaacgtctgcatttttacacttttacatacaatatcatcaaaagaaatcagctttgtcataatttaccccatttaaaatcaattgattttgtattctaaacgttgaacaaaaaatgtaaagaaaaatgaacaccaaagataaaaatgtttactcttgatctacatcacaaaaccgaacatttacaggttcagtcagttccaacactactactaaagtgttaaaatctcctcaaatttttaaattcactttaatagcgaggtataaaatggcatttcgtatcgaaaaagacactatgggcgaagttcaagttcctgctgataaatattgggctgcacaaacagaacgttctcgtaacaatttcaaaatcggtcctgaagcttcgatgccaaaagaaattattgaggctttcggttatttaaaaaaagccgccgcttatgcaaaccatgatttaggtgtgttaaatacggaaaaacgtgatttaatcgctcaggcttgcgatgaaattcttgccaataaacttgatgaccaattccctcttgtaatttggcaaactggttcaggcactcaatcgaatatgaatgtcaatgaagttgttgcaaaccgtgcacatgtcattcaaggcggtaaattaggagaaaaatccgttattcacccgaatgatgatgtcaataaatcccaatcttcaaatgatacttatcctaccgccatgcatattgccgcttataaaaaagtggttgaacatacgttaccttgtgtcagacgtttgcaaaaaacgttagcagaaaaagcagaattatttaaagatgttgtaaaaattggtcgtactcatttaatggacgctacaccattaactttaggtcaagagttttcggcgtatgcggcacaacttgctttcggtatcaaggcactggaaaacaccttaccgcatttgcgtgagcttgccttaggtggcacagctgttggtacagggctaaatacacctaaaggctatgatgtaaaagtagcggaatatattgctaaatttacagggttaccttttgttaccgcacaaaataaatttgaagctcttgcaactcatgatgcgattgttgaaactcatggtgccttaaaacagttagcagtttctctttataaaatcgccaatgatgttcgtttattggcttcaggtccacgctcaggcattggggaaattctcattcctgaaaatgagccgggttcatcaattatgccgggtaaagtaaacccaacgcaatgtgaagcaatgacaatggtttgtgcacaagtactaggtaatgatgtcactatttctttcgcaggtacacaaggtcatttccaattaaatgtgtataaacccgtcatggcatacaatttcttacaatcggcacaattattaggtgatgcttgtgtgtcatttgatgaacattgtgcaatgggtattgagccaaactatccacgtattaagcaacaactggagcaatctttaatgttagttaccgcacttaatacgcatattggttatgaaaatgcagctaaaattgcgaaaactgcacataaaaatggtacaacattgaaagaagaagccatcaatcttgggttggtgagtgcggaacaattcgatgaatgggtacgtccggaagatatggttggcagcttaaaatagttcacttattgaacatttaattaaggcgagatgagttctcgccttattttttactacaatagctttaacttaacattattttttataactgaattggttccaattttgatttttgttccgtagttaaaacatctgttgaaataatatgtaatccggttttgttattcagtcccaaatcagcatggaaataatcaggtaatttgtacattgcacctgttataggatcaacaataagtaacccaattaagcctccaaatacaaagtttccaatataccaaccatcaagtttcgcttctaacagaaaagtttggcttttggcatttttaccttcaggggtaaaagtaatttcatatttttcgcctttgaaatatccggctcctgctggtaagacaacattttgaggtgtttttccggatgtaataacttttccagctctattttttatcacaaagtaggcattactagggtttgattgaattgaaacattataatcgcgtttactcacgatagttgcacaaccggtagcaaacatagcgacaaatgctaatactgataattttcttaatcttttcatggataaatcctcttaaatgtgtaaaatggtaacaattatactaatctgtctattagtgttcgaagttagattttaggtaacaatctatattttgactagaaacgaataagataaattactacctaaattgtgattaaaattacccaatttgtgaggttctcatggcaatgcataataaaattcgcctgatgcgggaagtccgccaatggtctcaagaagaaatggctcataaaatgaatatgtctctaagtggttatgcaaaaattgaacggggcgaaacaaagttgcactatgataaattggttcagattgctcgtatttttaatatgaacttagcggatctgatagatattgataaaggtgtaattttttgtatgaatgagaacagtgattatatttatacaaattatggcaatatgagtgaatcatcgttaattgaaatcgaaaaattaaaactgacgcttgcacataaaaatgagttgcttattcaaaaagaaaaagaaattcaatcacttaaaaagattattaccctgttggaaacttcaaaataaggcatttctctgatgtgtcgttgattggcaagaacaccactttaaaaattacctgttggcgaaatgatatatgttttaattactttgctggatcataatattccgttatgtgttcttttagtgagccggttgtccgaaaaaattcattggctgataaaatagcttaaattttccagcatttcattaattatttaaccttttatctgtttgtctttccctttaaaagtgtcttattttatcaatcatctttgtgaaatttttgagaaaaatttgaaatgatatcaaatgcttctgtaatcattcgcctgttgtaataattgccgactttctttcaaaaattgctctgaatactcaccaaaccattcccgcacttgattaaaacagtctataaacccctgcttgttattatgttcaaagaaatttagactttcttcatagctttgttttagactcttaatcacttccaaattctccgatttgtccataataatatctgcataaagttccgcatcttgagcaaataaacgtccgatcatggctaattcaagacgataaatgggtgaagatagggcaagcaattgtgccaactcaataggttgttttgataaatgcaaaccatttgcaaaggttgaaaaatgacgtaaggcttgtacatacgtcatacttttatcatgttcggttgcatcaacttgataaattttcgctccccacatttgaatttgttccaaaaaccattggtatttttcagggtagcgaccgtcacaacgtactaccacttgctttgccatattggtaatatccggaccaaacattggatgtaatcctaatactgcaccttgatgcacttgtaacattttttccaacggttgacgtttgactgatgttaaatctgttaatagcatattttcggttagataaggctttagacggtcaatcacatttaaagtttgtgcaattgggacacaaacaataactacatttgcattttgtaaaattttatccgcactttgccaatcctgtttctctaagacagcaatttgataaccggaagaagacaaataacgagcaaataatgcccctaattttccctttcctccaacaatgacgattttttttatttcaggatttgctgttttaaaaccgtattgattttctctagtataagattcccgcatcaaacgacgcaaaacatcttcaattaaatccggtgaaacacctaacttttccgcttcattgcgacgagcctgtaacatttcattttcacgttcaggtacataaatcggtaatccatattgatgtttcactttgcctacttttctgactaattctaagcgttgagaaaaaaggtgtagtaattcacgatctaagcaatcaatttctgttcttaaattttttaaaacgtccatagctattttcatcttactaatatagtttgtacatttattattacaatggttgtaaaaaataacttacaaaataaatatcaaatacgcaactaaattttataaaaaaataccgcactttgcgttctgattaatccgcaatcgtttgcttgtgtaatttatattatgctattcttagcattatttttagtaaaggaattcttatgcaagataataaacctcaaatagccattgtcatgggatcaaaaagtgactggtcgactatgcaagaaaccgctatcattttagatagcttggatttaccttaccatgttgaagttgtatcggcacatcgcactcccgataaactctttgagtttgcagaaaatgcagaagcaaaaggttataaagtgattattgctggtgctggtggtgccgcacatttacccggtatgattgcagcaaaaactatcgtgcctgtattaggtgtgccagtaaaaagctcaacgttaaatggtgtagatagtttatattctattgtgcaaatgcccaaaggcattcctgtgggaaccttggctatcggatctgccggagctgcaaatgccgctttgttagcctcacaaattctcgctgctttcgatccgcacttagcacaaaaattgcaccaatttcgccaagctcaaactgacagtgttttgaataattccgatccgagagaataaggctttaattcttcattaggtaatgttgagcaatgaataaaaagccgatagttaaaacatcctatcggctttatgacttggtcagaaaaattaggctttataatttttattcaaagcaaatgtatatcctctcaaactgttgtttaggactttccggtatccatcctgctatccttagcataagtcatttggtttcccaagccattttaattagttgtcttttgacactactaagagttcaatacctttttctctaattttttctctcatttctaaagacaaaccttcatccgtaataattgtatggattttatttaaaccacacacaatattcgggctttttcttccaaatttgctggaatcggctaaaaccacaatttttttcgctgcatcacacattagagaactcactttatagacctcattaaaagtagttagcccaacgtctaaatcaaagccatcagtaccgataaaaagtatatcaaaggttgaaccgataaaagcagattcagcaaaataaccgtgaaaagaagccgatttttcacgaaatgtcccgccggaaattaataaattataaggtttattcagtactaaaatagcattaaagattgttaaactatttgtcattaaagaaagattatcaaactgctttaagtatgggatcatttgtagcacagtactccctgcatcaaaaatgaccgaatttccttcactaataagcgttgctgctttttgcccaatacgttgcttttgttgaatattaattgctgttttttgtgcaatcggtttatcttctttgtcctctttattgattttttcttctcgttcaagaagttcttcatcaattaagacgacacttccataagtacgtaagacctttctatcttcttcaagtgcggttaaatccttacgaattgttgcacccgtcaatttaaaatgagtagccaaaacatctacttccgttcgcccatattttgctaaaaacgctaaaattagctgtcttctttcaaaaggtttcattgttcctccaatttagcaaaaattggagcgaaccaatctatgctaatatagttttagttttgtcatgacatctaaaagtgaagccattctttcatcggcaattgaaaatttttcattttcataattggaattcaccaaaaatgtagttaaattggctgctttggctgcaattaaaccagtaatactatcttcaataacaatacattcttgtttttcaatccctaatttttttactgctctcaaatagacggcaggatgtggtttgccatattcttcatccattgcactacattgaattgggaagtaatcccacaattttaagcgatcaaaaatggtcttaattacaactggaggcgatgatgtagcaactgccagtttaatatgattagattttaaaaacgctaataattcatacagccctttcaaggctatacctgtttgtgcaattgcattacagccattttccaaaattgcttcacttaatttttggttggatacggataagttaaattttttaatccaagtttcactcaattcatcgatccgtttacccctagtgaatttttcacactctttctcggtaattgcgataccaaattcagccaataccgcaatttgagcctttgcccattgaggttctgaatcaatcattaccccatccatatcaaagataacactattgatttgcatcctttttctccattatcgcatttttcaatgaaaaaatattcaaaatgaaataaaatttacattgttttttgatcttaacaactatatccggaagatattgctacttttaacgcaaattgtgagcgtttatcagttggaaaaattttttccggaataatttgatcaagaggtaagccaatgacgtcaactaacttttgtggtctagcaaaaacagaaaaacctttcatgtgaagactatccacaacttttttctcttcattaaatgccaagacaatcacagattttggattaaaacgaccgctgttacgcccaacagtgatttttcctttcttgcttatttctagaaaagcttggttaaaggctctaatttgtagccagcctagaatagattgcaaaagccacattataattgagaatgtaatcagcaatgtaattggatccatttttacctcttaataaaaagccatagagtctgaataatctggctgtttactcatttagaacatcacttgaccgccagtaatattaattgactgtccagtgcaataagccgcttcttcgctagcatagaattttaaaacattcagtacatcttgataatcacaacctcgctttaaaggtactttatcaatataaacttgctccacttcactctccgagataccaagtttagccgcatattgtggaattaaagattggaacatcggcgatttcaataaattgcctaacattaatgaatgaactgtaatgcctttgtcagcaagatctaatgctaaggattgcgttaagccaacaccgccaaattttgccgcactataaccagaattgtacttacttccgactttacccgatttagagttaatttgaatgatacgccctttaatgccatcacgaatcattaaacgggaaaaatgcttggcagttaaaaagtaacccgttagattcacttttactgataaatcaaaatcatttaaattgaaatcccaaatgggtgaagcttttgcagtacctgcgttatagaccaagacatcagcacgaccaaatacacaatccgttacttttgtcaaagcttcaacgcttgattcatcgcccgcatcaacttgcaccccaattgcatttccttcgccttgcttgacgttaatatcagcagctactttttgtgcattttcgccatttaagtcggcaacaacaatacgatagccggcatccgctaaacctttagataaaaatgcccctagtgtttgaccaccaccgacaacgatggctacttttttttcattattcataatatattcctttaactttcaatttgaaatcatttctaatttggacttaatcacgtttaataactaagatggaactttccattaatgtttttggtggaacaccaacaacatgaacacttcccggaaattccgcttcggtcgccccatcaaaacggaaagtaatgtgtccgagtgcggataaattatccgacgctacactgccaatggcggtaatcggatattcaacaccatcaaattcggcaatatcgccaacttgtaaagcgtcgcttaattcagatggattgtgtaagaaacagtaatcttctaaatcggcaggtgcattttgtttgaaagtgattaacatattgtcgtttagtgcatcatgagcaaaattgccgattttagtaaacgttgttttatagataatcgtcatttgaatattccttttgttttacaagcggttggtttgcaaatttaaccgcttgtaaagtgattactgataaatgaatgcagataccgcccatgcaattaatactgtcggtgcaccagtcaaaaaacgactgactaatacagaaggtacgcccactcgcacagtatcttgtttcgcttctgccattgaaagccccacgggaatgaaatcacaagcggcttgagcattgatggcaaaaagtgccggcagggctaaatgtggtggaatgttccctaaaccgatttgtgtccctactaatacaccgataacttgagcaataacagctccgggacctaagaatggagagagtagtgggaaagaacaaattaacgcaagagtaactaaaccgagtgggctatttgcaagcggtgttaaaccatgagcaattaaatcccccaaaccggaagcaataatgattccaatcaaggcggaaacgaatgccataaacggtaaaatggttttcaggactgtatcaatagtatcacgtccggcttggaaaaagagtgcggcgacagaacccatgcccatacctatttttgccaataaaccattactttgttcggtgatttttttacttgaatcatactgttttgcggtagttgatgaagcaattttttcttcagatatgacagaaagggctgcggcatccacatcaattaacgaaatattattttcttttacggcagaaacataaatatcttcaacaataaattctgctaaaggtcctgatttgccggttgcgtgaatattaatagttggaatgcgacgttttgggtaaagcccacaacgtaatacaccaccacagtcaacaattgcaattccaatttcttctgctggcggttcgccttctttaaaaccatctactgcttcccagccagttaattccaccaatttattcacaatagcaggacgagtgcctccggtcatataaagtatttttttgccttcaataatagataatgttaatggaccaccccaaccaccgttacctttttcaatataaactgctttattactcataatgtattcctctacttttcattccgtttaattagtttagtgagatagattcacttctctatctaatgtaattcccattcttttttcaaagaaagctgtggtaaagtccgtaatccaaccacggaagaagttagtgaacatgccgactaataaatagctaacagctaaaggtccaagaggtaatcctaaagtcgttaaaccactggcaatacctaaataaacgaataattcacctgggttgatatgaggaaataatccgttcattgagtggcagctataagatgctgcggcgtagtaacttggtttataacgctctggtaagaagcgtcctaaacttaacgtcataggattgcaaaaaacgaaagtgccaattaccggtaagatcaaataacgtgaaataggattgcctgcacttttctgtgccagtctttctatacgatcttgcccaataaatttaattaaggcattcattacaaccagtaatgagattaatagaggtaaaataccattcatcattccgactaaggtttctccccctttttggaacaaaccgataaaccattctgctccgtgtgtgattgcttcgatcatacgacctccaattttcaaaataaaacatattttttcatctctgcattttagagacatgtaaatagtaagttattttcattttaaaaactgtgaagttgatcaaaaaatcaaaatttatttcaaaataaattattattgtttcggtttgaaatattgattgagtaatttggacggaaagaggcaccttttgttttaaacacataagaatttaagttaagtaaatgcgaaaaattaagcctttttcatcaagcaattgatgatttattcgtcgcagagacgaataaaagtacactggttttaagtaatggtttggaaatggaaaagggcgataaacccaaaccacctcattatcatcatgtcgtgcatgataaaatgatgcaccaagcagtcaaacaacatttttagttagaaaaacaatgactcacacacgatggagggcggattaaatcagcaactcttttttattgatgatattcaaggttatcgtgctgagaaaaaatcagttttcaggcaatctgaaaatactttttgaataaatggtcatagttgaattggaaaatatcctaaaaattaaagtgatgaatttttcaggatatttttattttaaacttgacatttaaaaaatgtcatgataataaaacgtaaaaagtttattatggtaagaagggaatgaagaaaaaatatataactgcaattctgttattaatatcagcatatgcttattcatataggattaatgttatagatgattatgatttaattgataaggaatatatagaattttggaatagagatgaacttataaaacagatagaagtattaacaatagaattattaaacagaggttatgtaacatcgaaaattattgataaagaagagaatttagttattattcctggaaaaatacaaaaagtaatattacaagataattcgacaaaaaatgcaaaattaaaaaaggaattattaaatttaaataaattagagggagagatattaaatattcgtgatattgatgaaatagtatctaaatttaaaaaaataaaaggtaataatgtaaaaataagggtggaaaatatcaaaggtagtcaagatagtaatataataatcataaatgactttaaacctgcgatatatcctaaaatttctgcagattattctaaaggtattaattcggattcttatcgtggttttaaatatgttgttggatttggtttcgaacaattaataggtatgaatgacgaattaaatgtgaacttttctctattatcagattatagaaatatgagcttgaaatataaaatacctataagaaataatgaagcaacaatacagtatcagtatacgaaagacattttaaatgaagatgtagaaacaatagaaagagaaatattattgaatgtaaatacggatattaataatatagatttaaataattcgataactataaataataaaaggtttaatgtaaggaaaaatacgaatataacaaacaattggttttatgagtttgaaacaagtttagtgtatacaaaattattgaatttaagtggttattatgttcaattaatgttaaaacctaaaataggtataaatattgcggatataagagcatataaaaaaaaggattatgtaattacatcaggtatagattttaatttatattctaaatactatgatttaataacgaatgtgatttataataagaatatgagttcggatagtgtgtatgatcgttatacgagaaaacttaatatatatgggattgataatatcccgttatcaatagcaaagacagataaactcatagttatgaataataaactgaaatatccaatgacaataaacaaaattaatgtaataccatatatcgatgtggcactaggtagtaattttaaagaatattcaactggaatgagcataggttcaaaatttaaatataaacaaacaagtattaatctagaatactcaaggagtaataaaggtaattcagttttaaatttaaatttagggtttgaattttagtgaaaggaaatcttagtgaaaaggagtagttatgtataatgagaaaaaagtattaacaatggtatatttatttgcagtgatatccgctcaagtaaatgcacagaccgtgaaaaatagggacacggaggtagaaaagaaggatggtttcgatataatcaatattaacacgccaaacacaaagggagtttctgttaataacttaaatgaatttaatgttaaagataaagggacagttatcaataacattgagtctactcataaatataagacagttcattttggtgaaatcgatggaaataaaaatataaagactaaagaagcagatatagcagtgttgaatgtgaaggggacgagtaatacaagcttaaattcaactttagaagctgcatcatcaaatccactaaaagtatacatagctaatgaaaatggtataaatgttgatggtggtaaatttgtaaatatcgacaaattggtactgactacaggtgttgttgatgacaatgatatgtcagtgtcggttaaaaaaggtgatgttaatgtttcatcaaaaggaattagcggcgttaaggatatatcgatatatagtgaaaaattagataataaaggtaaaattgctgcagaaaacacaaaaatagtactaggacatagttctataaaaaataatgaaatatcttcattagatgataattatgtgagtgcgagtgatttgggggctatttatgggaatgatatacaaattcagtcgacggggtatacggatattaatgttaacgaattattagcaaaaaataatattaatattaattcaaaaggtaaaattaaaaacaatggagatattatatctggaaataaaatagatataactgctaaatcgcttgaaaataaggggactgtagattttggtaataatacacatgaattaaaatggatagatgctaaaggtaatgtctacactaaagaacaattagaaaaagtgtggaataaaagaatgaaacaaactttaacaccagaatatgcatttctttatttgacgggttctttattaaatcaatgggctactgatgaagaaatggcaaaaaggttaagcccagaggctaatatttttaaaagatttgatgaagctttaaataaatttaatgataaagatacaaatacttttttaattagaaaagataaagaaaaagttaaaaataaacataaacaaagagattttgttaataaaggagatatttatgcaactgagatagatgataaaaaaatattagaagcagttgcagtaagtaatgttaaagccaatcaatctattatttcttcaaaaaacattaaaattaatttgactgatgatttattaaatcaagatgctagtatagaagctattgatgaattagatattaaagctaaagctaaaaaattagttaataaaaatagtttatcaaatgatataacattgaatgatggatatgaaaatttatcttgggatttaatggttttacaaaaagatataagagccaattatgatataatttatgaaaaaggcttggtttctgatcaggcagcaagaaaggctaaaatagctgctgtgaataaatcacaaattaaggctaaaaatatgaaattagatgtagataatatagaacttcacgatgatataaatacaggagcatctattaaagcagataagttagaaacaaattctaaaaaaataagtttaaaaggtcaaagtatagaagctaaagaatataatatgaaaactgatgagcttgttttgaataattcaactatttatacagataatatagatattggtgctaaaaatgttaaacttttaagtaaaaaagataaggaaatagtaataaaaacaggtaaagaaaatttaacaaaagaaattatttctagttcaggtatttatgctaagaataatttaaaaattaaatcaaaagaattgcaatcaaaaggttcaattattaaatctgataataaagcagaaattaatgttgaattactagaaaatcttgctgaaaaagttacaaaagattataaatcatcttatgatatttctaaaacatttagaaaaattaaacataacgaaaaaagtgaaagagcggtagctagttttatttatgcaaaagatttagttttagattctaaaaaaacaaataatgtagggagttatattgtaggtaccgattcaataaactataaatcgggtacaactaagatagatgtcttaaagattaataatgaattagacaaaaattatggtgtagataatggtatattaggtataaactataataaagttaagaagatggaagatgaagcagttgggtctatagttttaagtaaaggtgaaataaaagctaagattgataaagagctagaaataattggaagtagccttaaaggaaaaaaaatctttatagaagctagtgatgttaaaataacttctaaagaacttgacaaaacaacagaaactgaatcaagacaattacttgctggggatttaaaaggtggttttgaaaagaatgctactttagataatatatcagcaaaagtagatatggaattatataaaaatgaaaaaatgatagttaaagaaaaaaaacattcaaaatcagaaattgaaggagaaaaagttacaatagtagctaaaaatgaaaattcaataaaaggttctcaaattaatgctaataatttagaacttaaaggaaaaatagttagaatagaagatgatatttctaaaactgaggttgagaagaatacagtaacggtttcagcgactaataaaattgcagtaaatgaaggaaatttagaaagtgataataaattaataattagtaaaactaaagaaaatttaaatactgaaacttctaattcctcaaatattaatgctaaagctaatgtgaaaatagaagcagacaaagtgttagtgaaaggttctaaaattgaaggacaagaagtagaaataaaatctaaagaaaaagttgatatagttaaatctcaaaccaaagaagattataaaaaggattctgaaacagttacattagggtctaatgttaaattagatgctaaatctgttgcaattattcaaaccttaaagaaaatgtatgatgaaaaagacaatctttcaggatatgctttaaatccagtgtcaggatatcaaaagataaaagaatataaggtaatgctggaaaaaaatattgataacattaaagaattagttgctaatgtttcagataaaaaactagatcctgaatctttaggggtaacgatgaatgttgaaaatagtattaaatacaatactaatcatttaacatcttcaaaatttgataataatgaaagtgaaattaaagctgataaagttacaattaaaacagaagagttatcattagaagcatctaagattaaaggaaatgaagttaaaatagaagctgaaaaagtgagtttagaatctgctgagaaaaaagtaaattcaaacgaaacagatgccagtgttcaagtagctatggtacatgaaattataagtcaaaatacattatttaaaggtgattcaactgttcaaaacaaaggaaattataaaacagaacatacttcaagtaaaatagaagcagaaaaaatagatttaaaagctaaagaattaaaattacaaaattctcaaatagaaacaaaagagggtaaagttgaaactgataaattaagtgtatatgataaggcagataaagaaactaaatatggcgttactctagcaggtatgtataatggaggtacaaaaattggggttgggagtgctacagctaaagtagagcatgatcaaaaagttaaaaatgtatctattgtaaaagttgaaaatggtaaagttgatgttaaaaaagaagataaaaagaaagatatagaagtcaatattgatgttaatactcaattgggattaaatgtagatccaagcggtgatgttaagggtaaagcaagtggtggagcaaaaactaagctagattcaaaaggtaaaaaaattcaaggtacaggttatgtaggtgttattggagatttagcttttgaagatggaaaaatcacagatgtaaatgtgagtactgagcttaaaggagatttgacaattacaccagaaaaatatgttgatgaaataaaattaaaagttaataatcgtttatctatagatcatgatggtcaaataagtaatgatttaactggtaatttatctactgttactcaaattaatactgaaaatatcaaaagcaaattaaatgtaggtgtagacggtaatctagttactaaaaatatggatataattcaaggtggaataaaaggaaatgctggtggagaaatagaagcaatagtaaaaataaatgataccgtcgaatttaaattaagattgatggctgaaggtaatgtaattaaggaacatggaaaatacataaaactagattctgaattatcgtcaaatgctaatttgaatgtaaaaggtgcaactaaaaatgtttccggctacattaatttagctaataattcgagcataaaaattaataacgaaaatggcattaaagattattcaatagataataatgttgatggtaatctaaagtctaaaggaagtataggcgaaaatgtttcaggagacatagacataaatttaaaatcggatttatcgaaaaaaatgtctcaaaatataacaactagtaccgctgttatggggaacggaaatctaaaagttgaaggaaaactagaaaatttagatggaaatatgggattaaatctaaatggaaacgtggcaggaaatgaggcaggattacaagagttaacaggaaatgctaaagctgatggaaaattacatgctcatggagtattggaagcgtttagtggggatgtaacattagctggaaatactgaattaaatgcaaaagtaaatgaagcattgaaattaaagggaaatttaagtggtcattctaatattagtgttgagggacagacagatgtagtaggtggcaaaattcaattaaaacctcaagttaatatatcgggagataatgttaataaattaacaacatttgatacgagtactaatttgaatggatacattgaatcgaaagtgaaaaatgagtatgtaagaaacattaaagcgaacctaaatactatattcaaaactaaaaagtttgaggtggagacttttgaatcaagtcttgatagtgaagttagatctaaatataaggatatagaatttaatttagcttcaggagaaagaatatcattaaaagactatattcaacaaaaaatatctagtgataaataaaagtttaaagaaaagaaaatttttaaaacaaattttgatctgacactaaaaagttggactgctattcaaaggactgattttgatattgtatcggactcagtccttttaattgaatccgttcttcgttgtaatttaatcagttggttatttagtcctcctttcggaggcttgatcaaagagtagttttctgttttataaaattttgggtagtgaataatactcaacgccatatcaacctaatatcaaaacaacatactgaataaacaaattaaaaggatattcctagtgcttgtttcattatttgttctttgacgaaaccaaatcggttagtggtatttaaacctataccacgtactaactttttcaccggattatcgccgttaaagagttcttttagtccctgcattgccactaacattttgactgccgctgttttctgacatcgttcataatgacgcaaatatcggtattcaccaatatccattcttaaagctaaatttttgttaatttcttgtgcaagtataacagcatcttgaaaacctaagttgactccaagtccggctaaggggtgaatagtatgagccgcatctcctactaacacaatgcgatgtttggcaaaactacgtgcataacgtgcagttaatggtataactttgcgttctccacgcacctcgcataatcctaaacgattgtcaaaagctacagataagtttttattaaattcattttcctctgcgtttaagagttcattggcttgttgtggcggtaaagaccacactattgagcataaattttgttgatgtaaaggcaagaaagctaagatgctgtctttgttaaaaatttgtctagcacaattcttatgcgattcggaagtttttacgttgcaaactaaagcatgatgtccataatcacgaaaaatgagcggaatatctgcttgtttacgcacccaagaatttgctccgtcagcccctacaattaattttgccgataacatttgtccatcatttgtggttaaaattgcattgttttcggtgagtcctaaatgatgcggaagtgcggtaataatttccacatttttttgcatttttaccttttgccaaagttgattttgaatcagatgattttcaataatatgccctaaatgctccagccctaaactttgtgtatcaaattgaatttgtgcaaaactatctttctcccaaacatccattttgtcgtatgccgtcgctctcaaattcaataaagcttgccaaacttccaagttttgcaacattttttcgctggctaaatttattgcactcacacgattactaagttgctcaatcggttctttattaggaaatccttcaattacagcaattttcacagggctatttcgcaagctggcagctaaagccaagcccaccatgcctccaccaataattgcaatatcaaatattttcatcgtcattactccaaataaagataagtttaacaccagcctaacgttgctttagcaaaatactgtcgcaataaagaagattgagcaaatgccatcaagccaagattacgcccaatttgtagcggtaataaattattggcaaaaatagagactaaaccatcagttaaactaataatattacgttgatcggggttgcgttgtttcgcatagttttgtaaaacttgatatttcccccaatcttgttgttgtaaataagcttgcgataccacatttgccaaactcattacatcacgaatacctaaattaaatccttgtccggcgaccggatgtaaagtttgacaggcattaccaactaaggcaacacgatcttgaatatgttgtgccgccttatataaatttagagggtaggcaaaacgtttaccacattctttcagttttcccactcgccaaccaaaacgttgttgtaagcggtttaaaaattgctgatcatcaaggtttattatttcttgactatttttgacgcaccaaaccaaagacattaaattgtctttcattggcaataaagcgattggtccttcttcggtaaaacgttcaaaggcacggttttggtgaggttgttgtatcaaaatattactgataatagcggtttgttgatattcacgcacaagctcttgtgtaatacccaccgcacttgctacgttggattgagtaccgtcagctcccaccaataaatgagtgcttaaagtgcggtgatcttctaactgaatgtttacttgctcaacatttcgttcaagagaagaaatagaaacgggggaaaaataatctatattgctacaatcctgcatagctcgcatcattaccgctcccgcctgatttaattcaatgacagcgcccagagccgcaagacaaaattctttagcagaaaactctgcaataccgaaatgccctcggtctgacacatgaatatgtttgataggttcacaaagaggcgttaataattgccacagcgattgcttattcggcaataaaatctgattgaaatgccggcaacttcctgatgataaagcaatacagcgagcatcaaagccaccgtgatgatgctgatgaggaatttgtttttccagtacggctatttttattttaccctgtgtctgatagctgagtgccaatgctaaactcgcaccggtcataccaccaccgacaattacaacatcgtagcgcaagtgcatatttttacccctctttcttcacttaaattattgttgcatcagattttcaatatcctcaatttcttttggtacagcagaggttaaaattttattcccattttcagtaatcaaaatattgtcttcaatgcgaacgccaattcctttatattgttccggtacatttgcatccgtaccgatatataaaccgggttcaacagtcaacaccatgcccgcttctaaagtgcggtctcgttttttactatttcgatctccgttttgcacctcactgctgtagcttcctacatcatgcacatcaagtcccaaccaatgccctaatccgtgcatataaaattgacgataactttggttatcaattaaggtttgtacatcgccagttaaaattcccaaacgaactaaaccctccactttaattcttaccacttcatcatttgcctgttgaatactattgcctgccactaacaactcaatagcacgtttttgtgcttttaatacaatttcataaatttctcgttgtgcctgagtaaatttaccgttgacaggaaaagtacgagtaatatcgcctgcatacatagcaaattcacaacctgcgtcaataagcaacaaatcaccatcttttaaaatttgatcattttcgttgtaatgtaaaatacaagcgttttcgccaccggccacaatactgttataagcgacatatctggcaccgaaacgattgaagtgatgtagtatttcactttcgatttcatattcaaagcgattagggcgggtttgttgcattgcgtgaatatgtgccaaagcagaaatttgtcctgcttgttgtaacaaagcaatttcatttgctgatttaaacaaacgcatttcgtccacaagaactgcccaatctaaaacttgtgcaaattgcacagtttttctattcagtatatcttgtaaaaactcagttccccaaggttgttgagctgaatggtaataaagtgcggtgatattttccctcagttgtaaaaactgtgtttcaaattcggcaatatcataagccaaatccacagacaacgttttcgttgcattttcaatccccaaacgtcttccgttccacgtttccattaagggatctttgggccgcaaaaataaaatactttgtgatttttctgcagttttgattaaaagtaaaatactatcaggttcattaaagcctgttaaataccaaaaataactgtcttgtcgaaaaggataatgacaatcctgattacggattttttcctgagaggaaaaaacgatggtaattgaattatcttttaattgtgctaatagtttcttacgacgaaaaacaaactcatcgttaggcatttttgccatataagcaagatccataaatactccttaatgcttaaaaaacacactgaattctagcataaaaaaacaagtcattcgattgattaaaaaacaaagctaatctatctataaacagcaggcaataagaaaacaacgcactttattaattgagcgagtttagctaaatacattgactaatgtaatacggttgtctttgtttccgataatggtccgaagtgattaaagaataaaaaggtaatcgttctcacatattcaataatttcttctaatgctttagacaactcctcttgatcatctttttcatcatatccaagttgtccaatagcttgtaaatcatccagtgcttcgccgatttcgcctacctctttatttaaattaggctgatttagccctaatcctaataaaaaatggttggtccattccgacagagcatcagctcgagcaaaaacattgtcttcttccggtaaccaaagctcaaaattaaatttatcaatatcggataaagtgcggtcaattttctgataaatttgttccacttctttcaataaggaagtgggatacgcatgatcatcatttgtaaattgataaagaagatactgccaacgttgatctgtaataccaccgcaaattaaaccggtaagaaaaccatgcaattcagccaccgttaatgcaatatttgcttgtttcagttgttgattaaattccgaataaataagaggtttttctgacatttgatatttccttgaaaaataatatgccagtttatcactgtttaacttcagcaaccaagaaacaaagggatttttatgacgaaaattttttgctatggcataataaggacacttttagcttttattataaaataggaaaacacatgtcaaagctcattgaattatccgtatcagggcaagtactacgtttaaattgtcctccagaacaacacgatgctttacgtcaagcggcacatttattagataatcgtgttatggaaatgagagagcgtaccggtattttacagatggaaaaaatcctctctattgttgcattaaatttaagttttgaactgatgcaggaacaacaaaaaactcaaacaatcgaaaatgtcattaatcaaaagattgctcaactcgaaggatctttggagaatattttggctcaaaaaacaactttttaaacataaatctgtgatctaatcgtgataatttgaaaaatattctagccaataaaaataaattgcgttagtattgcactcaaagattacctgagatgtttgccggcggattaagtccctgagccgatactgaaaacttaatgaattggcgtcctgttgttggtgtgtatgcttgctagccatgcaagaaacctaaaaacaatattagccgattcccttgaaccgtagggttcaaggaccgaacatccgcagcggcatctcggggctattcttagttatccagccaatatattgtcccatgagtatttctaatcaacgtcaacaaatacgacaacttattcgagaaaaaagacaaaaactgaccgcacttgagcaagctcaagccgaacaaaatattgcacaaaaagccttggatgcgattgaaaagtttcgtgcggaacatattgccttgtatctttcttttgatggtgaaatttcaacgaaattactcattgaacaactttggcaacaagaaaaaaaagtttatttgcctgttttacacccattttctcccggaaatttattattcttagctttccaaaaagatacacctatgcactacaataaattcggtattttagaacctaagttgaatgtgcgaaatgtactgcctgtttcacatttagatttgatttttacgcctttagttgcttttgataaggatggaaacagattaggaatggggggaggattttatgatagaaccatacaaaattggcaaaaaaaatcttttgtccctgtcggattagctcatcaaattcaagaagtagaacgactccccattgaaagttgggatattcctttagcagagattttaaccggataatgaacgcttaaaacgtttacggcggcgatgaaaattcgccgaagcggtacttttttttattgcatgagtaataggcatcatatcaggcgttttttgtcttgtgcgacgatggtaattcaaaaaataatgaatggaattcaccaataaagcactagctaaaaatagaatgattaattcaccatataactgattaaaaatgtggtttattttacgctgacttgcttgtctatatttcatatcaagagtaatacgtaaaaaaccctcaataccattagatgaataaatcggttcaacaatttgctgaatattcggttgcgtagtattgttcgctttttgatttaagttcaatttatcacgcaaaccgacaaaattcgcactatgtgctaacaatttaccgttagcaccataaacagaagcatcaatcacaaattcttctttcgtaaagtcgttcagttttttggtcaaaaggtccgaattggggttatccgcaaaaagcatagcaaaaagattagcttgctgacgcactaataaattggataagtagttcatttgattaattgttgctaattgtgaccctaatttaaacttattaatcccaaataaaatcaaagacataatagttagacaaagcaaaataatgccgagcaacattccaatttttagtattttttcttttattaagctcaagttattttccctaaaaattattaaataggctagaataagaacaaagaaataatttacaggatcttttatgcaaactcaaaacctagagacaattatctctcattatacgctattcccttccccaattttatcagaaaaacccactgtacttggagaagattacttcattctctatggtaaaaatttaaatttggacagtttattaacttttcaacaaaagtgcggtgaaaattttctgattttagattgttggaatcggttagattacactgttgccttattcaaaagcaattggcaatcgcagtacttaactgttgctcatcaactggaacttgatattgcattattaaattttgatgctcgtttaagtcaagcgggattattagttatggatatggattcgacaattattcaaatggaatgtattgatgaaatagccaaccttgccggtacaggaaaattagtaacctccattactgaacaggctatgcgtggagaacttgattttgaacaaagtttacgtcgtcgagtagaaacgcttcaaggagcacctgaacatattttacagcaagttcgtgatagtttacctttgatgtgcggtttaaccgagatgttggaagtgttacaaaaatatggttggaaaattgccattgcatcaggtggatttacttattttgccgatcatttaaaagaaaaattaaagctggattatgcggtttccaatcacttagcggttgagcatggttttctcactggaaaagtacaaggtgatattgttgatggagcatataaagcggaaacgttaaaatctttagctcaaaaatggaatatagatttaaaaaatacagtagcaattggtgatggtgcaaatgatttagccatgatgaaagtcgcaaatctaggttgtgcttttcatgccaagccaaaagttcaacaacaagcacaagttgtggtaaactttgccgacttaaccgcacttttatgtattttaagtgcaaatgatcggattacaaaaaattaaaattgaggagcatattatgccgtcatttgatattgtttcagaaattactctatatgaaatacgcaatgcagtagaaaatgcaaatcgtgtattaagtacacgttatgattttcgtggtgttgaagctacaattgagttaaatgaaaaagcagaaaccattaaagttacgactgaatcagatttccagttagagcaattaattgaaattctaatcagtgcctgtgttaaacgtgatattcaacataattccttggatattccggctgatagcgagcatagcggtaaattgtatagcaaagaaattaagctaaaacaggggatcgaaacagacatggcaaagaaaatcatcaaattaatcaaagacgcaaaactaaaagttcaaacccaaattcaaggtgagcaagttcgtgtttcaggaaaatcaagagatgatctacaggcgactattcaattagtaaaaaatgcggaattaggtcaaccgttccaatttaacaatttcagagattaatttctatttttcctacagaaaccgccaacaatataattgcacatattattggcgtttttttgtattcaaattattacagtattcttaaacttcaatactagtgtaatttaaagctaataggtactgtaatttggcttggtagcccagcaggtttttgcccaatactgcgtgcactttgaaccgcacttaatgctgccttatccaaatcttctgaacctgaagattttgcaatacttatttgacttaagctcccatcagcaccaatagcaaaactaacagtaacaatcccttgttttcgcatcatttttgcacgttgtggataacgtttatggcgttcaatttcacgacgcaacgcacttttataagcagcaacttcatcagtactatttcctgttccaatcaaattcggattagatgttgttactccgcccaagcccatagcctgcgaatttactttatcgtcagaatcaatatccctatcacctttaggtaaatcttttggctgtttttgttttgtgcgttccttaggtttcttcttcggtttttccttcggcttatctttcggtttctccggttcttttaattttttctccggctcaggtttaattgttggatctgcaactacctctgttactacaggatccggctcaggctcagctaccggttctggcttagaatcatctacaaccatacccattaacatttccattgagatctcagtaccaatcaaatccgcactatatccatttgcactgtcatctggtttagtaaaccaaaaaaaaccgccaattaatgcactatgaaatacaagcgagaagaaaaaaccaaaccaagaatgatatttcttcattacttacttgccttttctttcatcgttacaatagcaacatttttaatttcgttttttgccataatatctgtcaaggttacgaaatcttggaaagtagatttagcatcgacttttaatgtcactttttgctctttatcccaagtcgcaatttcttgctccagttcttctactgaaatgggcttatcattaaaaaaaatctccccttgctcagttactgtcaataattttgctagatcatcggacttgaaagcaactgtgctacttgctttgggtacattaacttgaattttcccttgagaaataaaagaagctgtaattaacacgatggcaagaagcaccaacataatgtcaataaagggaataatattaatttcatcaaattttttcacattactcaccaatattttgctgactgtttaaggctttccattttagacggttaacttcaactttacgtcctaaaccgttgtaaaataccatagaaggaatcgcaacgagaataccgactgcggttgcttttaaggcaagagataagttaagcatgatagcagcggcatcaatatcccctcctgagttacctaattcatagaatgttaataaaattccaattaccgtacctaataaaccgacataaggtgcattagaaccaattgttgagataatggtcaaatgacggtttaaatcaatatccaactcatgaatattcgtgtaactttccactttaattttggtcagatacataaaacgttcaacggaaaaccataacataataaaactcattacaccgagtaaacccaaaatgatgtagtcaatataatgatgtaaaaaattaaaaaactgtgacattggataacattccttgctgataaaaattacaaataagttattgagaattaatttcaattagggtgaggattttaacaaattttattgagagatcaagctataatattaaaaagagactttttgagtaccgcacttttccatctgttttttattttagtgaaatttgacgtttttcgttcatactatgataaagcaattagaagaaatgactaattgaaatactgaaagataagacactagtaattgacatccccctgccttaaggccgggcggatgtcaaattctcaaaaattggctgatgactaattctacgcaccatgcgatgatttcattattctctgccatttgtattgctttttccagtttttcaaaggctttttgaaatgagagaatctatttaaatctttttttcgcttcagctatcgcttcagctacacgtagtggtgaaactccgccttttgcacaacgtttatccaaacaggattgtaaagataagatttcataaacatcctcctctatagcattactaaattgatggaattccttaatacttaaatcttctaaacctttatgtactttaatagcataaactactgtttcacccacaatatgatgagaatcacggaaaggtacacctttggcaactaaatagtctgctaattctgttgagttagaatatccctttaatgccgcttcttttgttctttcaacgctaactttaatatcttctaacacaaaagtcgccatatctacacaatcttgccaagtatccaacgcatcaaaaatcccttctttgtcttcttgcatatctttattataggcaagaggcaggcctttcactgtcatcaacataccggtcaaagcaccgacaactcttcccactttgcctcgaattaattcacaagcatcgggatttttcttttggggcattaatgaagaaccagaggttactcgatccgacagctccacaaaatcagcctctccactattaaaaatgatcatatcttcagcgaaacgtgaaaggtgagccatacttaaagacgcagtggaaagaagttcaataatatgatcacgatcagatacactatccaaactatttctcgttgccatcgcaaaatccagatcttgtgcaagtaaatcacgatcaatggcatacgcagtaccggctaaagcaccactccccaaaggacaagtattcattcgttgataagcgtcttgtaaacgaccataatcacgatccaacatttccacataagccatacaccaatgagcaaatgtgattggttgagcacgttgcaaatgagtataccccggcattactacgtgttgattatgctctgctgtttccactaatttacgttgcaattcacgcacggaatgctgtaattcagtaacacgttgtttacaccacatcttaatatctaatgcaacttgatcattacggctacgcccagtatgtagttttttgcctaagttacctactttatcaatcagtttactttcaacccaactatgaatgtcttcagcatcatcttgtaaaatcttttgtggatttgaccgcacttcaattagtagttcactcaatgcgttttcaagaacttgctgctcttgctgagttaaaacatttacggtaaccaatgctttagaccaaccgattgaaccctcaatatcttgttcagctaaacgatagtcgaaacgcaatgagtcgttaaaatctttaaaacgtttatctgtcgcttgtgtaaaacgcccaccccaaagtgccataatcacatcctttttctgttattatttgtggataaatttagttctcattatctcacacaaagaaaagtgcggtcaatttaaccttcacgatcccttcttaatattaccgctaactgtcatattgatactaaacgactctactttttgacttgatttccgcttgtgttttctcatcgccatccagtacgacatttttctgcttattcggttaaagttaagagttttgatttaaattatgcgttacattatttaaaattactggaatgtatcatcacatttagatgtttgattcaagcaagaggaccttaatgtaatttatttagatcaatagtgcggtagaatttaagatattatttaataataaagggtgataggtttatcatgaaaaatttccgttggtatttaagttatagggcgggaagatttaaacattattggagaaatgtgcagtgtcaaatttatgtagaaacataaaggttttttttaaagtttttttgtatcgctttaaacaaaataaattaaatcaagcagcaggctatttaacttatagtactacgctggctcttgtgccattgattatggtgtttttttccgtttttgcggcgtttcccgtttttaatgaaataaccggcgagctgaaacaatttatttttactaattttgccccttcaaccggtgatgccgttggagaatatattgatcaatttgtcaataattccaaacaaatgagtgcggttggaattattagtttaattgttgttgctttaatgcttattcattctatcgaccgcactttaaactcaatttggcttgatactagtgtgcgtccggcaatattttcctttgcaatttattggctaattttgacgcttggtccgattgttattgcgacgagtatcggtattagtacttatgtgactaaatttgcaacctatacatttgaacaagatttgggtttatccgtgggtataaaacttcttagtttgatgccgtttttcttgacatggtttatttttaccgtgttgtatatggtagttccaaacaaaaaagtgagtattatacattctgccgccggtgcattaattgcagcagttttctttacattgggtaagcaggcttttacttggtatattacaacttttccctcttatcagttaatttatggagcaatggcaacgttgccaattatgttactttggattcaactcagttggacagcagttttattgggagctcaactttccgcagtactggcggatatacgttcacttgattgtggtaatattcaaatagaaaaaattaaggaagaaaaatgattgcattaattcaacgtgttagtcatgctaaagtggaagtcggacaaaatattgttgggcaaattggacagggattgttggttttactgggtgttgaaaaagacgatgatcgaagtaaagcggataagttggctgaaaaggtgttaaattatcgcattttcaccgatgaaaacggcaagatgaacttaaatttacagcaaatcggcggagaaatattaattgtttcgcaatttacgcttgctgcagatacgcaaaaagggttgagaccgagtttttccaaaggtgctgatcctgagttggctgagaaactttaccaatatttcagtcaaaagtgtgcggagaaagtgcgggtcgcaaacggacaatttgcagccgacatgcaagtgagtttaactaatgatggacctgtaactttttggttaaatgtataatataaaaataccgagtgttatgctcggtatttttatttctatttgaattaaaggaatttttcttttaattcttttgcgacagcaagttgtttttcagtcgcttttgctgtcataggttcacggcagtaacctgcattaacaccttgaagtttaaggatttctttaatagttaaatataaaccgttagccagtataccttcgattaagtcatttgtaacatgttgaatctcaagtgcttcagcaacttttcccgcttttgccaattcaaatatttgtcttgcacgtaaaccatttacattaaatgtactaccaattgcaccatcaacacctaaagagactgctggcaacatcatttcatcaaatcctgcccaaactagatggtttggataggcttttttcaagcgttccaataggtagaaatcaccggcggtaaatttaactcctaatactttgggattggcatagagttcaccgaattgctcaacgcccatattgacacctgttaagaatggaattgagtaaacgatcatattgttgccggtttcagcaataatcgtttcgtaataatgtttgatttcggcaaagctgaatttgtagtagaacggcgtgacggcggataagctgtcgtagcctaattctgttgcatatttacctaactcaacagcctcgtgtaagtttacactaccgacttgagcgattaatgcaacttgatcttttgcttcttctttggcaatacggaaaatttcttttttttctgcagttgagagcataaagttttcgccggtactgcctccgacatataaaccgtcaattttcattttatcaatgttataacgaacgatctcacgtaaacctttttcatttatggagccgtcttcgttaaaagacactaataatgcactaaaaataccttttaagtttttcatttgtttctcctgatataaaagggattaaatttttatttaatacgttgttctaaaatcacattaactgttttttgtttagtttgtaccgcactttcttcttccgcttgaacaatcaaggtgtaaattaagtccaatacaaaaagttgagctatttttgtaccgatagaatcgccttgtagctgcccttgtcgattaccgttgattaatacataatcagaaaccatagtgataggggagcgtaaattatgtgtaagagcgacggtaacagcaccgtttttcttggcaatattcaatgcttgaacggtttctttggaatagcctgaatgacttataccgataacaatatcacttgagttcattaatgcggcttgcatatacataaaatgattattgcttgttgcatcaacgtgtaatccaatacgcattaatttattttttgcttcttctgcagttaagcctgatgaaccgacaccaaacaggaagattcgttttgatacacgcattaattcaacaactttttcgagttgagcaaaatccagcaaattaacggtttctgaaatgacattatgaatgacattttgcaatttttctgcgatttggcttgttccatcaaattttgatatatccgtttccagtagagaattagattgtcgatcttttgtagccaactcaatcgaaagttgtaatttgaaatcagtaaagcctttaaaacctaatgttcggcaaaaacgaataaaggttgcttctccgacatcgaattgttgtgcaatttccgctaaagagttttgtcccaacaactctggagaagatagaaccgttgtggcaatccgtttctctgtttttgttaggctatcatacaaagcaccaatggtatccaatatattaccgctcgttgccgccataattgagcctcctgttagcgttttttgtttcttaatcgattaatgatatcggtattttaactaccaatttttttaagtgggtaacttgaccatgaacattacagcaaggtttgtgcggctcataaggaaaaaatatcgcaaacatttttggacgtaatgttaccgcacttttatgcggaatatcatcaattaactgataatcgtcttgctcattataagcagtacagtctgctaaattcggatattcaacaccatattcaattgtttccgcaccggaaattaatacttgaatatcaatatattgatgatgcaattctgcttttttatcttcagaagccacagtcgttgactccatgacattcatataaatttgatcggttaaatcatgtcgacctgtggtcaaattttctaaatccagcgtattaagatgatgacaaatattaatcatcacttgtggtaagttacgcttaaaatcatctcttgttaaatcaccaaaaatcattttttactcctattattatgggatttgttgcattttcatccaataagccgcaccaattaaaccagcatcggcaccgtatttagccggcgccaaaatacagtgataaaattttggcatgtcggttaaatattcttgaacgagggataagtatccctcagctaatccaacgctaccgcctaaaacaaccttttgtacatctaaactaatcaccatatcagcaattaagttagcaatagcttttgctgaggatcgaacaagtgcggttgctttttcatcatttttacggaacaagttgaacacttctttcggattacaaggtttttcccacttattcgcctcacgttcaattgctcgccccgccgcaatcgcttcaacacaaccacgacgaccgcaaccacaaattgggccgttcggatctgccaaagtatgcccgatatgaccggctataccatttagcccagtggataattttccatcaagaataattcctccgccaacgccagttgataccgtgataaaaataaaatttcgtaccgcactttggtcttgatcttggtactctgcacaaacagcagcctgtacatcatttagcaagccaatcggtttatctgtatggagagcaatgcttttttgtaaggggaaatcaaccagtccaccgagatttttaggattaagtgcggttaaaataccgttgttgataatgcctgtcgatgcaactgcaaccgcatcaaactgtcccgcataactttgcataatttgcttgatggcgtgatgcaatgcgactgtaggatctgcttgtggcgtgctgatttgctgacggttagagagcttcttttcttcaacaacagcggttgcaatttttgtaccgccaatatcaattgctaagcaacgcatacttttttccttaggtttagtaggatttagctgatttaaccgaggtgacaaaccagcttacaatatgttctaagcgagtcaatgccgaaccaacagtaacacaatcagcaccaatttcaatggcggctttagccagttttggtgtgttgtagcgaccttccgccatcacataacaaccggcagcttttaaatctttaactaattgatagtccggttcttcgggaatatcaccacctgtatagccggacattgtgcttcctataatatcaaagcccagttgttggcaatataaaccttctttcagatttgagcagtccgccatggctaaacagcccaattcgtgaatttttttcaccgcactttcaatgtcaacaggacgtttgcgatcggtaccgtcaaccgcaataatatccgcacctgccgctgctaagtcttcaatatcttgtagaaacggcgtaatccgtacaggactgtcttccaagtctcgttttacaattgcaataattggtacattcacgrscggacgagttgcttttaagttatctacgccttcaatacgcaagcctgcggcaccaccgataatggaggcttgagccatcgctgcaacaatttccggtttatccataggaccgtcatctacgggctggcaagaagcgatcaatccaccttgaatagcggttaaaacttgtttctgtgataatgttgacatataaaactccaaactatgggaataactgaacgttattccttttctttataaatattgctctaatttacggattagtacctcgtaacctttcggactgaaatgtaagccatcggtacataaagttaaatccaatttgccgtcttcacccacaaaatcctgccaagtatcaataaaagttaaacccttagggcagtttttccgcaaataattatttaatgcaataatcggtgggttgtctgttgtagcaatattatttaccggtgttgcttccaatagaaagaattcggattcaggagaaattttgactaaggcttgccaaatatcacagatccaatccaatactttggcgtgagaatactcaggctctttaacaatgtcattcacccctaagaaaataaagacttttttacctaaacagttaatcaattgaggtttgataataacatctaaatattgtctagcactgacacccgaaatacctaggttggcaacacgtttgcctcttagttgaatttctggtgaaatatcactccacatatcaaagagtgagtgtccaactaaggtaatatcagcttgcttttcaaattccgcttttttaacttgataacggttgaaaatatcttgatctgtcagcaattttcggtccttaatttaacaatattgattaatattggaacgaattatataaaaattgaattttctcgcaatgttatttggtgttttactccagaaattatttaaatttgtgtgccatgtcacaattctgaaataaaactctataaatatattttaaaatgattttttgcttttagaatatactttcagcaacagtgcttttcccttcatatttttaataggagaacttacgatgaaatttgaaaaactcgctcttgcaactttagcgttgagtatgtctgcctctgtttttgcagcagattatgagctgaaattcggtatggttgcaggtaccagttccaatgagtacaaagcggttgaattttttgcgaaagaagtaaaagaaaagtccggcggtaaaattgaaattgcaattttcccaagtgcacaacttggtgatgaccgtacaatgttaaaacaacttaaagacggttctttagattttacattaggtgaaactgcccgttttcaaatcttattccctgaagcggaagtgttcgcattgccttatatgcttccaaactttgaaatcagtaaaaaagcattacttgaaaccaacttcggtaaggggttaatccaaaaaattaataaagagttaaatcttgagttattgtctgtagcttacaacggtactcgccaaactacatctaatcgtgcaatcaacagcattgcagatatgaaaggcttaaaattacgtgtaccgaatgcggcaactaatttagcttttgcaaaatatgtaggtgcttctccgacaccaatggcattctcggaagtgtatttggcgttacaaaccaatgctgtagacggtcaggaaaacccattaccaactatccaagcacaaaaattctatgaagtgcaaaaatatttagctttaactaaccatatcttaaacgatcagctttacttggcaagtcgtgaaactttagaggatttaccggaagatttgcaaaaagtagttaaagaggcagctgagaacgcagcagagtatcacactaaattgttcaaagagggtgaaaaaaatttagttgcgtttttcaaagagaaaggtgttactgtaactactccggatgtaaaaccgttccgtgatgcgttaaaaccttactatgatgaatacttaaataaaaatggtgcgttagggaaacaggcaatcgaagaaatttcaactctcattaaaaaataaaaaatgccctttccctagtgagggaaagggatagcttttttgttcggagtatgtatgaaaataatgaacaagttagaagaatggattggcggggcattattccttgcaattttcctgattttgattgcacaaattgttgcacgtcaagttattcatatgccacttatatggtcggaagaattagcacgtttgctgtttgtttatacggcattattggggatcagtatggcggtacgtgcacaacaacacgtctatattgactttattaccaatttaatgcagctgacaatcaaacgtatggcgatgacctttgttcaattattaatttttgtctcaattattctgtttatctacttaggttatggcgtttgggcagacgcaacttttcctatggaagcattaaaagctacctttggaacggaaattacgcaaaaatggctctacgcagggttgccgattattgcatctttgatgttattccgttttttagaagctcaagcagaaaactttagaaacaaagccacttacttgcctgtttcttttttccttgtaagtgcggtcattatttttgcgattttatattttcagccggagtggtttaaatctctgcgtatttccaactatataaaattcggtaaaaatgccgtttatatcgctttagcggtttggttagtgattatgttcttaggcacgcctgtaggatggtcattatttattgccgctttactttatttttcaatgacacgttggaatatcacttattccgcatcgggtaaattagttgatagcttagacagcttcccgttattgtccgtaccgttttttatcttaaccggtattttgatgaacaccggcggtatcactgagcgtatctttcattttgcaaaaacgttattaggacactacactggtggtatgggacatgtaaatatcggtgctagcttaattttttcgggtatgtcaggatctgctttagcagatgctggcggtttaggtcaattggaaatcaaagcgatgcgtgatgcaggctatgatgacgatatttgtggtggtattactgctgcctcctgtatcatcggtccgttagttccgccaagtattacaatgataatctatggtgttattgctaatgaatccatcgcaaagctatttgtagcaggttttgtacctggcgtgttggttaccatcgcattgatggtcatgaactactatgtttctaaaaaacgtggttaccctaaaacaccaaaggcgagcaaagcagaagtttgtgccgcatttaaagacacattttgggcaattttgacaccgtttttgattattggtggtattttctctggtttatttacaccgacagaagcggcggtcgttgctgctgcatattccgtaattgtaggaaagtttgtttataatgatttgaatctaaagaatttcctcaaaagctgtgtagaagcagtatctattactggtgtaaccgcattaatggtaatgacagtcactttcttcggtgacatgattgcccgtgaacaggttgcgatgaaaattgcggaaatttttgttgctgttgcagattcgcctatcacagtgttaattatgatcaatttgcttctcttattcttaggaatgttcattgacgccttggcactacaatttttagtgttgccaatgttgattccaattgcgatgcaatttggtattgatcttgtcttttttggggtcatgactacattaaatatgatgattggtattttaacccctccaatgggaatggcattatttgtcgttgctcgggtgggtaatatgcctgtaagtgtggtagcaaaaggtgttttacctttcttgataccaatttttatgaccttagtattgattacgattttcccacaaatcattacatttatacctaacttgctaatgctttagcagtaaaactggggattgaaaagatagaagtcggtttatgattgacttctgaagaaatctatttttcaatgtgtatctggataggtatttatttttactcaacttaaataagcaattaagcaataatgttctatattatcatttgataaattaatttatcttaataaaagattaccaatcaatacaaaactcctgtacaatatctcggctttatttttccgcttagcgtgcggctaacgaaaataattttagtaaaagtaaagagcggtggtttttaagattatttttgctagtcgcaaattggaaaatagagcaataagattaacttactaatttataaggaacatattgtgaatccaattgtaaaacaatttaaatatggtcagcacactgtaacattggaaacaggtgcgattgctcgtcaagctacagctgctgtcatggcgagtatggatgatacctctgtttttgtaaccgttgttgctaaaaaagatgtgaaagaaggtcaagactttttcccgttaaccgttaattatcaagagcgtacttatgccgcaggtcgtattccgggtggtttttttaagcgagaaggtcgtccatccgaaggtgaaacattaattgctcgtttaatcgatcgtccaattcgacctctctttccggagggatttttcaatgaaattcaaatcattgctacggtagtttctgttaatccgcaaattagtccggatttagtggcaatgattggtgcatcagcagctctttcattgtcaggtgtgccatttaacggtcctatcggtgcggctcgagttggttttattaatgatcaatttgtgttaaatccaaccatgaatgagcaaaagcaaagtcgtttagatcttgtcgttgccggtactgacaaagctgtattgatggttgaatccgaagcggacattttaactgaagagcaaatgttggcggcagttgtttttggtcatcagcaacaacaaattgttattgaggcaattaaagagtttgccgccgaagcaggtaaacctcgttgggattggactgcaccggaagcaaacaccatattgattgaaaaagtaaaatctattgctgagaatcgtttaggcgatgcttatcgtattactgaaaaacaagctcgttatgaacaaattgatttgattaaagcagatgtaattacgcagattacagcagaagatgaaacaattagcgaaggaaaaattattgatattttcaccgcacttgaaagtcagatcgtacgtggtcgcattttaagaggtgagcctcgaatcgacggtcgtacagtggatactgtacgtgcattggatatttgtaccggcgtgttacctcgcacccatgggtctgcgatttttactcgaggtgaaactcaagcgttagccgtagcgacacttggtaccgagcgtgatgcacaaattattgatgaattaaccggtgaaaagactgatcacttcttattccattataatttccctccatattctgtgggcgaaacagggatgattggttcgccaaaacgtcgtgaaattggacatggtcgtcttgctaaacgtggtgttgcggcagtgatgcctagcttgtctgaattcccttatgtagtacgtgttgtttctgaaattactgaatctaacggttcttcttcaatggcatcggtatgtggagcctctcttgcattaatggatgcgggcgtaccgattaaagcggcggttgcaggtattgcaatgggattggtgaaagaagaagataattttgtcgtactgtccgatattttaggcgatgaagatcatttaggtgatatggactttaaagttgcaggaactcgtgaaggtgtaaccgcacttcaaatggatattaaaattgaaggcattaccgcagaaattatgcaaatagctttgaaccaagctaaaagtgcacgtatgcacattttaggcgtaatggagcaagcaatcccagcaccaagagcagatatttctgattttgcaccacgcatttatacaatgaaaattgatccgaagaaaatcaaagatgtaatcggtaagggcggtgcgacagttcgttctttgactgaagagacaggtacatctattgatattgatgacgacggtacagtaaaaattgccgctgtagataaaaacgccgttcaggaggtgatgtctcgcattgaagatattacagcagaagttgaggcgggcgttgtttataaaggtaaagtaactcgtcttgcggactttggtgcctttgttgctttagtaggtaacaaagaaggtcttgtgcatatttctcaaattgcggaagagcgtgttgagaaagtgagcgattatcttacaattggtcaagaagtaatagttaaagttttggaaattgatcgtcaaggtcgcatccgtttaactatgaaagagttggcaaaagaccaaactaagaatgaagaaaatcttctgcaatcggaagagggttctccggttcaagagtaaatttgatagagtaacttgaagggcaaattatatttgccctgtactgtatctgattactttcatcaatatagtgttttaaatgtgctatccattgaaatttaatcaataatctttttgtttatcttcattgttatttgaacaatattgaaattttgaatgaagccatttatccagcaaaacaagactcaatataagcaagcaaataaagcttgttgtttttaattaggcatatatttccgttgggtatcgttttgccgaacttgtaaaattgattgacaagtaaataatccatgatgaatgaactcaaacatggattccgtgttgtgaaacgagctttacaacgattaattaacctaaggcaaaagcatattgagctttcctttttacattcgagtatttttaatgactgaaacaacaattacttttaatgatttagggttacctgaattcatccttaatgcagtgtccgaaatgggcttttcaactccttccccaattcaacaggcttgtatcccgcatctattaaatgggcatgatgtgcttggcatggcacaaaccggtagtggaaaaacagcggcattttctttgccattattggcgaaaattgatactaatgaaaaatatccacaaatgttagtaatggcaccaacccgtgagttggctattcaagttgctgatgcttgtgaacagtttgtgaagttttctaaggggatgcgtattgttactctgtacggcggacaacgttacgatattcaattaagagctttaaaacaaggtgctcaagtggtcgtcggaacaccggggcgtattttagatcatattcgtcgtggtacattggatctgtcaaatttacagtctattgtattagatgaagcggatgaaatgctacgcatgggatttattgatgatgttgaaaccgtcatggcggagcttccagagcaacaccagaccgcacttttctctgcaacgatgcctgctccaattaaacgaattacaaaacgctttatgcacaatccgcaagaagtaaaaattcagtcaacacaacgtactgcaccggatattacgcaaagctgttggtatgttcgcggttttcgtaaaaatgaagcattgttgcgtttcttagaagtggaagattttgatgctgcaattatttttactcgaactaaaacagctacattagatgtcactgaattattggaaaaacacgggtttcgtgcagctgcattaaatggagacatgacacagcaattacgtgagcaaacattagatcgtcttcgcaatggaagtcttgatattttagtggcgactgatgttgcggctcgtggtttagatgttgaacgtattagtttagttgttaattatgatattccgctggatgcggaaagttatgttcaccgtattgggcgtacaggccgagcaggtcgtgcgggccgtgcgattttgtttgttgagcctaaagagcgtcgtttattggggaacattgaacgcttaatgaaaaaagcaattgaagaagtggaaatgcctaatcatcttgctttacaagaatgtcgccgtaaaaacttcgtggctaaaatcactaagcaattagaacatcatgatctagaacaatatcgtagcttattggaagatttatttacggcagatcaggatcaggaagacattgccgcagctatgttgatgttattacaaggcaaacaaaaacttattcttcctgaagatccagtgtttgaaaaacattcacgacgtaatgatcgtagagagagaggggagcgtcgaggtaaagaaaatccacgttctgagcgtcatgggtatggtactccgcaaccaatggatttatatcgtattgaagttggtagatgtgatggtgttgaggttcgtcatattgtaggtgcaattgcaaatgaaggggatattcaaagtcgttatattggacatattaaactttatgacacttattcaacgattgaattgccacagggcatgccaaaagaattgttacaagtatttgctaaaacgcgtgtattaaataaacagatgcgtatgtctttcgtaagtgcggtcaattctgaggaagagtttgaagccggctcaggtggtaaacgaaaagggcgttatgaacgtgagtttcgtggtggacgtaaatttaatgaaaaaagtaaccgctctttttctgaacagcgtaaagaacgtagagaaagaaagagataaaagcaaaggggctattacagccccttctttctgataaagcaaataattaataaaaattttattaacgactgcggaaaataatacgacctttactcaaatcataaggtgtcatttcaaccgttactttatctcctgttaaaatacgaatatagtttttacgcatctttcctgaaatatgtgcagttacgacatgaccgttttctaattccacacgaaacatcgtatttggcaaggtttctaaaattgttccctgcatttcaatgcaatcttctttagccatttattcctctaaatatgaatgaaaaaataaaaacttcgggattatactctattaatgagaaagacgaaaagaatttattctattaaagggatattatttttatttagttaatattgaaaaatttatcggattgaaaaattgtatttactgactaaaaagattagtatttgactgaagttatactatattttttattaaaaaggataatctatggcaagaattgcaattattcccgctagggcaggttccaaaggtattaaggacaaaaatctccaattggtaggcggtatttcattggtcggtagagcgattttagcggcacaagaatctggtgtgtttgatcaaattgttgttaattctgatggtgataatattctcaatgaggctgaaaggtatggtgcgaaaacatttttacgtccttctgagctggcacaaagtgatacgagaacgatagatgttattttacattatttgaatgaattaaagattgaaaaaggaagtgttactcatcttcaacctacctctcctttaagaagcggaatagatattcggaatgcaatggaaattttttcaggagggtgtaaatcagttatatcagcttgtgaatgtgaacatcatccttataaatctttcattatggaaaataatgagattattccacatagagaaatcagtgattttgaagcacctcgtcagcaattacctaaagcatatcgagcaaatggtgctatctatattaatgatattgaagcactattaaagaacaaatatttttttattcctccaataaaattctattttatgccaactcattgctctgttgatattgacaatacgctggatctgcaaattgcagaaaaattaattcaaaatcaatattagaggttatatttttaaggataaaaatcagcgagatgtgtcgattattcgctatgctaaaattgtgctgtgttagcaattttcaaactttgatttatatttggaaaacatgaacattctcattacagggggagccggatttatcggctctgcgcttattcgttatctactgactgaaactgaacatactatcattaatgtggataaattaacctatgcagccaaccttgatagcttacaaagtgcggtgctcaatccacgttatttttttgagcaagctgatattgttgatcaacctgtgataactcaaatatttgagcaatatcagcctgaggcagtaattcatttggcggcagaaagtcatgtagatcgctcaattgcagcaagtactgaatttattcaaaccaatattgtagggacatttgctttgcttgaggttactcgtcattattggcttaaattgcctgcaaataaaaaagagcggttcgtttttcaacatatttctacggatgaagtttatggtgatttaattgactctgaacaggcttctactgaaagtagcccttatcaaccaagcagcccctattcggcttcgaaagcagcttcggatcatttagtaagagcatggtatcgtacctacggtttacctattctaattacgcattgtgctaataattatggaccattccaacattcggaaaaattaattccacgtatgattttaaatgcagtgaaagggaaacctttgcctatttatggagatggtttgcaaattcgggattggttatttgtagaagatcatgtacgggctttatataaagtattacaaaaaggaaaaatcggagagagttataatattagtgcaaattgtgcaaaaaccaatctagaagtggtgcagacaatttgcgatttattagaacagttagtaccaaataaacctaaaggaataaagcaatatcatgagttgattattcatgtcgaggatcgccttggtcatgataagcgttatgccattgatgcttacaaaatccaaacgtctttgggctggacacctttacaagattttaccgcaggcctacgtaaaaccgttcaatggtatttgaacaatggaaattgcagaaatggttaagactgttagttaagcagagtagtgatacacacaacgacaggtttaatatttcgtatgcagtatataaaatagctaatcattaagaggtatatacaaggtttaaataaaaaacgttacataaaaattaaacaaaaaattaacaaaagtgtgatttttgtcatatttttgtaacatcaggtttattttttcttctatttttgtttacaattcacatcgcatatatcgttgcaattatatcttataatttatttactggagtaagttttatggccctctttttgagtatctttcctatcgttttattaatttatttaatggtaaaacgtaacgcattaccttcttatttggcattaccttggattgccgctgttgtattaattattcagttagttttcttcggtacagatattaagattgtgagtgcaaatattgcatctgcacttgtagcagttcaaacacctatcactgttattttaggtgctattttattcaatcgtttctctgaagtatcaggtgcgacgaatatattacgtaaatggcttggtactattaacccaaatccggtggcacaattgatgatcattggttgggcgtttgcttttatgattgaaggggctagtggttttggaacgccggcagcgattgccgcacctattcttgtcggtctaggtttccctgcgattaaagtagctgttttgacacttattatgaactctgtgcctgtatcattcggtgcggtaggtacaccaacttggtttggttttggtcctcttcatttgggcgacgctcaaattttggaaatcggtgctatgacagcattaattcacgctttcgctgcattggtgattcctttaattgccttaagtttcgttgtaagcgtcaaagaaattcgtcgaaatattatctatgtttatttaagtgtatttgcttgtgttattccatatattttattggcacaagtaaactatgaattcccgtcattagttggtggtgcaatagggttacttatttcaattctacttgctaataaaggtattggcttggctaaggttgaaaataatattgaagctgcggttccttttaatgacgtagtgaaagcattgtttcctaccgcacttttaattgctattttgattatcactcgcctccaacagttaccgttcaaagcgatgatgaacgatgcgacaacttggtttgcggttcaattgggttcgttagggcgttttgaaatcagccatggtttaattttcagcctgaaagacattttcggtacatcaattaattccagctataaattattgtatgtgccggcactgattccatttgttgtaacagtattaattgctattccggtatttaaagtatcggcagcaaatacaaaagatattttcgttaccagcttccaacaaactaaaaatccattctttgcacttgtcggagcattgattatggtgaatttaatgttagtgggtggagatggttcaatggtgaaaattatcggtaagagtttcgctgctgcaacaggagagtattggactgttttctctgcttatttaggtgctgtcggagcatttttctctggatccaatacagtatctaacctgacatttggtagtgttcagttatcaactgcagagttaaccggcttatcaacttcattaattcttgcgttacaatctgtcggtggtgcaatgggtaacatggtatgtattaataatattgttgcagtaaattcagtattgaatatccaaaaccaagaaggggcaattattaagaaaacagttattccaatggtaatatatggtattattgccgcactggttgcattgtttgttatcccgatttttttctaaataatgtatacttttggtaagcagtattctttgatgctgcttacttttatttattttaaattgaaatattggagttcttatgaatgtcaatttttatgtcacttgtattgctgatgtggtgaaggcaggcgtggcaaaaaatacagtattgttgttagagaaactaggttgcaagattatcttcttggaaaagcaaggatgttgtggtcagcctgcaatgaatagtggctatacaaagcaagcattggaaggaatgaagaatttagtatcaacttttgaggtaaatgattatccaattgttgcaccagcaggatcttgtgtttacgcaattaaaacttatcctgagcaattttctcgtttcggtgaaactgaatgggcagaaagagctcaaaaggttgctgatcggtttcatgatcttactgattttattgtaaataaattaaaagtaactaatgttggtgcaaaattaacaggtaaggctgtttatcatccatcttgtagcttatctcgtaaattgggtattgtgaatgaacctttaacacttttacaaaatgtaaaaggattggagcttttacctattactaaccagcaaacttgctgcggattcggtggtacattttcggtaaaaatggcagaaatctccggagaaatggtcactgaaaaagttgagcatattacagaagttgaacctgagtatttaattggtgctgatgtgagttgcttaattaatattggtggaagattgaaccgagaaggcaaaaagattaaaatcatgcacattgctgaagtattaatgcaggaggataaataagatgtcactaaaaaccagtaatcttgcatttaaacagcgtgtggacaatcaaatccataatgaaatgatgcgtaaagcggtagttaaagctcaagaaactatcggtgctaaccgtcaaaaaatggttgatgaattggggcattgggaagaatggcgtgatttagccaaacaaattcgtaatcatgttttagcaaatttagatgcttacttatatcaattgagcgagaaagttcagcaaaatggtggaaaagtttactttgctgaaaccgctgaagaggctactcaatatattcgtcaagttgcgttagaaaaaaatgctaaaacaattgttaaatcaaaatcaatggtaactgaagaaatcggtttaaatgaagtgcttgaaaaggaaggcatgaaagtcgttgaaactgatttaggcgaatatttattacaaattgttggagataaaccttctcatattgttgtacctgctattcataaagatcgtcatagaattcgccaagaattacatgatgccttaggttatgaaggaacggaacaaccggaagaaatgaatgcttttgtgcgtaaaacattgcgtaaagatttccttgaagctgatattggtatttccggttgtaattttgctgttgctgaaacaggctcggtatgtttggttactaatgaaggaaatctgcgtttagctacaacagtaccgaaaacccatattgcagtaatgggtatggagcgtttagcaccaaccttccaagaagtagatgtattaatcaccatgcttgctcgtagtgcggtaggtgcaaaattaacggcttataatacatggttgacaggtcctcgtcttgaaggcgaaaccgatggtccagaagattttcatttggttattgtggacaatggtcgttcatctattttggaaagtgaatttaaggaagtattacgttgtattcgttgtggtgcttgcttaaacacttgtcctgcatatcgtcaaattgggggacatggttatggttctatttatccggggccaattggatcggtaatatctcctttattgggaggttatgaagaatttaaagaattaccttatgcttgttctctttgtactgcctgtaactcagtttgtccggttaaaattccattggcacaactcatctcaaaacatcgtgaacacattgcacaagctggtatgacaccaatgttagaacggttgtctatttttggctttactttagcaaactcaaatccgacgttatggaaaataggtgtaaaaattggtgctaaagtggcggctaaagtgattaaaaacggtaaagcaccaattgaggttggagcgttggcagagtggactaaagctcgtgatttaccaacaccagatggcgagagtttccgtcaatggttccaaaatagaggtaaaaattaatggatttacaaaatcgtgataactttttaaataaattagctaccaaaatgggcagacctcgtcaattcattcctgagcctatgcctgagttggtcaataattatccgacaacgcgtttaactgagttgagcaaaaccgacttagttgatgagtttgtgcgttttgctaaagtgatgatggcggatgttattgaaacaagtgaagctgaactaaaccgcactttactggaagtttgcgagaaatatggtggcggtagtgttattttaaataatgacaaaagattagctgatttgggtattttgcaatctgtccaagaaaaatacgatagttatatttgggatttaaatcaaacggaagaaaattttgcccaagcggagaaagctaatattggtattgtgtatggtgagtatgggttggcagaatccggtggcattgttttattttcggataaagattttggccgttcagtgagtttattaccggaaaaatccattgtggttttacgtaaaagcaccgttttaccacgagttgcacaattggctaagattttacatgaaaaggcacaacgaggagaaaggatgccttcttgtataaatattatttcgggaccgagtgctacagcagatattgagttaattaaagtcgttggtgtacatggaccggtacataaaatttatattgttattgatgacttataattgataattaaatcgttaaaaaaatgaccgcacttcaacataagtgcggtcatttcttatttgatttataggttatggcaacacattacttttaagccattgttcaaattcattattgttcataaaacctgttatacgagcttgttctatttcctttcctgattgatcaaagaaaatgatagtcggcaatcctaaaacagtcagttgcttcatgagttcagtattgtccggactgtttttggtcatatttacttgtaacagtaagatatgctcaaataaaggctgtacatttgaagcactgaacgtatatttttcaaactctttgcaggcaacgcaccaatcagcataaagatccaacatggcaaccgattttggattattagcaagaacgtgttgcaattctgcataattttgaatgcgttggaattgagaatgagaggggtgttgttgaactgcgttttgttcgtgattccaatttgaattgagcaagaatagtgcggtaaaaacaaaggcgataatccaacctaaccagttttttcttaattgaataaaaaaccagacaatgaaagcaaacaaccagcttgcccataaataatcactatattcaggtaaaacacgagaaagtaggaaaataggtaacagtaacatgacgaaaccgaaagcagctttgaccttttccatccaaacacctgactttggtagaattttgttgccaaataaagtaattaacatcagaggaatgcccatgcctagggccaataaatagagtgtaaatgcacccgttgtgagatcgccggtttgagctacataaagtaatgctcctgataatggcgcggaagtacagggagaggcaacaagacctgcaatcattcccatcacaaaaacaccgccaaaagcaccgctcttttgttgttggctgagtaaggtgagtttagtttgtagcgagcttggcagttgtagagtaaagactccaaacatggataatgctaatagaataaaaataacggataggctgaccagtacgtaaggactttgcagtgctatttgaaatggtaatccgattgccgctacaattaatcccaataatgtataggtgagtgccataccttgtacataagcaaagcttaaccccaatgctcgtaaactattcggtctttgatttgcaccgataataatcgctgacaataagggaagcataggtaagacgcaaggagtaaatgcaagccctaagcctaacaagaaaaaacctaatggtgcgtatttgttatttaataagtttgcagcaagttgattttgttcagggtgttgcatggcagtttttcccgcaacacttaacagatctttgttaatagagatttcttgagtttcaggcggataacaaagtcctttggtacaaccttgataggtaatgagtgctttattaaaagaactatccgttggaagattgatggatagatctaattgatggcgataaatctcagtttctccaaaaaattcatcttgatgtagctcagcggtagggaaatgaagattctcaatagaaacacgttgatttttgttatcatcattcactaattcaatgctgatttcttttttatacagataatagttttcagcgatagcccaatgaagatcaagtttttttccttcttgttgactactgaattgaaatgcttcatggctttttaaaaattgtgtttttttaccaaaaatgtttccttgtgtttgagatgcaaaaaaaagtgcggtgaaaaaaatataaaaaatagttaaaatttttttcattcaaatgatccctttctaaatagttcaatcgttcaatttatgcagggcgacataatatctgtggcatcagattaaagcaagcgttttatgatctacgtcatgaaatctagctgtatggaaaaaattatctcttttcacttgttacgataatgttgcaattatacaataagccccgaactgaattggattatattctaggaataaagtatgaacataccgcaaattttgattgttgaagatgaagtgattactagaaatatgttaaaaagtatctttgaggctgaaggctataatacactggaggcggctgatggtaatcaaatgcatcgtatacttgctacatgtgaaattaacttagttattatggatattaatttaccggggaaaaatggtttaatgttggcacgtgaattgcgtgaaaatacaaatacagcattaatgtttttaaccggtcgagataatgaagtagataagattttaggtttggaaatcggtgcggatgattatattactaaaccgtttaatccccgagaattgactattcgtgcaagaaatcttttacagcgtacgatgcaagaaatacctaaatctggcaccagtcaggtagaacagtatagattcaatggttggacattagatttaaattcacgttctttaattaatcctgacggagaagaatataaattacctcgtagcgaatttcgagcaatgttgcatttttgtgaaaacccaaggaaaattcaaactcgtgaagagctattgagaaaaatgacgggaagggaattaaaaccacaagatcgtacagtagatgtaacaattcgtcgtattcgaaaacattttgaagatcatgcagatactccggaaattattactactgttcatggtgaaggttatcgtttctgtggtgaattagaagaaaactaattaatttgaatagggtaaaaagtgtcatccttttggtattttttgtattggtttgcacattgccctttttctaaaaatgaattgaaaatagatctcactactttcaatactttttctagtctaatattttgataagaaaagcatttttaagtaacggaaatctcttaaaaataataagtcaaagagttttattttttatttctcgtaagacttgtaaaatatttttcattgcgagatctaatggagcaactaggcgtagcctttcccctgttttaggatgttcaaaacaaatagcaaaagcatgcaagaataaacggtttaagccaagtgcggtcatttgttgattaaaatttttatcaccatatttatcatcaagtgcgataggatgacctgcgtattgggtatgtacacgaatttgatgagttcttcctgtaataggagatgccttaactaaagtagcattattataacgttcttcaatgctaaactttgtttctgaaggcttaccttgttcacttacttttacaattcgttcgccactcgtaagttcatttttcaacaatggtgcttgtatcatcttacaatgagattgccaatgaccacgaactaatgccagatattctttttgtatggttttttcacgtagttgctcatgtaggctacgtaaagcagatcgtttctttgcaataagcaatatacctgaagtatctctgtccaagcggtgtactaattctaaaaaacgtgcttcagggcgtaatgtacgtaatgcttctattgctccaaaatttaatccgctaccgccatgtactgcaaggcctgaaggcttgtttaacaccaataaataattgtcttcaaagataatttgttgttccaactgtgcgactttattcaatttttttgaaataggggtatgttctttttccgcaatacgaaccggtggaattctaacaatatcgccattttgtagtttatactcaggtttaattctgcctttgttgacccttacttcacctttacgcaaaattcgataaatcaaacttttgggtacgcttttcaattttgccaacaaaaaattatcaatacgctgtccactttcatcttcattgattgttagtatttttacactttggtttatgattttttcattaatatgtgtcatttttaaattttttcagcttatcaaattgttatgtatcatagcataaaaataggaattaccttgctaaaatttatttatcagtagataatagagcctatttttgggtaggtaaaatactcaaaactaaataagtcatcattgatcattttttaatgctgcgaatggcgtaagacattaatatatgaagtgatttcttggtagattaaagtaaacgacagcttgcaaaattaaacatttcaataattttgtttgtattaagaaagctattttaacacccgtcttaataacgcattcaatgcatccggcaactgacagtcgagagacaggcattttgtgacagataagaggtagattgcgaagcaaagagcggttattttaatgctaattttgataataaaatttagagaaaatttagacaatgaaaagaatgttgattaatgcaactcaaaaagaggagttgcgtgttgctttagttgatgggcaacgtttatttgatttggatattgaaaatcctggacatgaacaaaaaaaagcaaatatttacaaaggtcgtattactcgtgttgaaccgagtttggaagccgcatttgttgattatggtgtagaaagacatggttttttacctttaaaagaaattgcacgggagtattttccggatgattacgtttatcaaggtcgtccgaatattcgagatattttatctgaggggcaagaagttattgttcaggtcaataaagaagaacgcggtaacaaaggagctgccttaacaacctttgtgtctttggctggaagttatttagtcattatgcctaataatcctcgtgcaggtggaatttcacgccgtattgaaggggatgaacgtttagaattaaaagaggcattaagctctttggatgtgcctgaaggcgttggcttaattgttcgtactgccggtgtcggtaaatcacctgaagaattacagtgggatttaaaagtcttgttacatcactgggaagcgattaaacaagcctctcaaagtcgtcctgctccctttttaattcatcaagaaagtgatgtgattgttcgtgctattcgtgattatttacgccgtgatattggcgaaatattaattgatagcccgaaagtgtatgagaaagcgaaagcacatattaaattagtgcgtcccgattttattaaccgagttaaactttatcaaggtgaagttcctctgtttagccattatcaaattgaatcacaaattgaatctgcgttccagcgggaagtaagattgccttccggcggttccattgttattgatgctacagaggcattaaccgcaattgatattaactcggctcgttctacacgggggggtgatattgaggaaacggctttaaatacaaatttagaagcggcggatgagattgctcgtcaattacgtttacgtgatttaggcgggttaattgttattgattttattgatatgacaccggtacgtcatcaacgtgaagttgaaaatcgtatgcgagaagctgttcgtcaggatcgtgctagaattcaaattagccgtatttcacgttttggcttactggaaatgtcacgtcagcgtttaagtccttcattgggtgaatcaagtcatcatgtttgccctcgttgtcagggaacgggaaaaatacgtgataatgaatctttatcattgtctattttacgtttacttgaggaagaggcattaaaagaaaataccaaacaagttcatactattgttcctgttcaaattgcttcttatttattgaatgaaaaacggaaagcgatccatagtattgagaaacgtcataatgttgatattgtggtagctccgaatgaagccatggaaaccccgcactttagcgtttttcgtgttcgtgaaggtgaggaaataaatgagttaagttataacttagctaagttgcatgaaatgaatgatgagacttatgttgttgaggacgcttttatttctcgtcaccttgaaaattcagcagcaacagtggaaagtgcagtcgagaatgcggcggtttcattagctattgaaactccagcaccaatgccacaagaaagaaaacaagagagagaatccttattgagacgtattattgaggggattaaaaacttgtttgctgataattcaagtaaaaataaaaaaaacaaaaatactcgtcagaataaaaatgctcgtcataatcgtcgtaaccaagatcgtcgttctagccgtcgtattcgtcaagagcatgagattaaatctgatgaaaataataaattagatacacagcattctcattatactgaacgttattctaagcatgctaagaaaggcgttgatgatccgcaaattcagacaaagaaagcgggtgagttggaaattcatacaaaagatgatgagactattgaaacaattcagcctcgtcgccaacgtcgtgatttgcgtaagaaagttagagttgaggaaaatttagttgatacgccaaatttgggatcaactgaagaacacgttgaaaatgaaaaaacaatagagcctgttacaagtttagaacaagcggttttacagacagaaaatgagaaaactcatgaacgtcaagataataactatcgtcatcgacgcttacctcgtcatttaagagtgaataatcaaagacgtcgtcgtaatgtagagttaaaatctgcgatgcctctatttgctgcggtagcatctccggagttagcgagtgggaaagtttgggttgatgttaatgtagttaattcaaaaaataacaattttttatctgtagatgaattactaaaacagcaatatcaacaagaggaaattgaagttgttattcctgctagtgaaatcttgatggatactcaatctgatgatattaagcctttaagtaactttgttagccaaccagcaaatgaagcagttgaaaagaaagttcaagaaaccttgcaacgtttaactcaagaggtggttgacgaatcatcaacaatcgaacgcacagaggtagatactaatatttctgtacctgagtttgtacgtgaatatcagtttaacggacgattggggacaatttctgcggttgtgcatacgaaagcagaaatgacacttgccaagtcaagtgatgagccaatacagcctttctcaatcgttgaatggcaagattctcgttattatttctatggtagaggagcggcaggacatcattgtgcaatcagccatgtttattctgaacctgctaatactaaaatagaataaatattttacatgaatgaaaattccacgcttgaatggaacatgaggaaatcatggacaatacaggcgtggatttttgtttttataaagtcataaaataggtataacgaagaaaaatctatagaataactttcttggttctgatggaaaatatcgtaaaacttctttttgttctttcgcaagtgagtatcggcttaaaacactctgtcataggtacattgtagtagagaagagtttgccatagtttagaaattttgaaaatgtttcaacacattgcaggataggggttaaatggtcccccctaccggacttgaaccagtgaccaagcgattatgagtcgcctgctctaaccaactgagctaaagggggacaggtcgtgaattatattgaataaaaataataaagtctataaaaaggagattaaaagcttaaaattcattcaatctcttgatttcaactattaatgtgcctcatcccaattatcacccacaccaatatccacaattaatgggactgataaatgtgccgcattttccattaaagacttaattaatgcagaatattcatctaccttattttctttcacttcaaataccaattcatcatgaacctgcatgatcatttgaatatcattttttttgatttcgttatgaatagcaatcatagctaatttaataatatctgccgcagtaccctgcattggtgcatttatcgccactcgttcagctcctttacggcgtattgcattagatgaattgatttcaggcaaatatagacggcgtccaaataatgtttctacatagccctgctcttttgctttttctcgaatatcaaccataaaagtttgcactcccggataacgttggaaatatagatccatatatttttgagcatttgtccgtgaaatgccaagttgattagataaaccaaaagaactcattccataaatcaagccaaagttaattgcttttgcacttcgacgttgttcacttgttacttcatttaatggaataccgaaaatctcagctgccgtagaacgatgaatatcttttccctcattaaatgccgtaatcaagccattatcttgagataaatgtgccataattcgtaattcaatttgtgaatagtctgcggcaataattttataccccttacgtgcaataaaggcttggcgaatacaacgaccttcttcatttttaatcggaatattttgtaaattgggatcactggaagataaacgtcccgttgctgttactgcttgatgataagatgtatgcactcgtccggtttttttgttcaccattgaaggcaatttatcagtgtaagtagattttaattttgctaatccacgatgttccatcaataatttaggcacaatatgtccctgttgagctagcgtttccaatacatcttcatttgttgaaggtgcaccttttggggtttttgcaatgataggtaaggctaatttagtaaagagaatttcttgtagttgtttggttgaagctaaattaaattctgctcccgcttcttgataaacttgttgctcaagtgcggtcaatcttctcgcaattttttcagattgctttaacaatgcctgactatcaattagtacaccattgcgttccatctttgataatacttttaccaaaggcaactcaatatcattaaataccttcactaaacttggcgattgttgtaattcttgccagaggacttgatgtaatttcattgtaatatccgcatcttcagcagcatattctgtcgcttgagcaatggcaattttatcaaacgttacttgtttttttcctttaccgacaatactttcaaattcaataacttgatgtcctaaatatcgttccgataaggcacccatattatgtcgtcctgtgctgtcaagcacataggattgtagcatcgtatcaaaacaaacaccgtttaattgaatatgatgattggcaaaaatagttaaatcatatttaatattttgtccaattttttgaatagacggattttctagcaacggctttaattgtgctagacacgtctctttatttaattgattttttacaagctcaaattgttcagcattttgttctgattcagtgaataaatctgtttgtgtcatttcttttacagcttgtttatgagccagaggaatatagcaagcctcgccgttggtcagtgcaaaggaaataccgacaagattagctcgcataggatctaaagcatcggtttccgtatcaacagcaataagatctgcctgttgaagtttttccagccaactatttaatttctcttgagtatcaatagtttcatatgaagtgcggtcgattttaatcgtttttttgaccgcacttttcgactcagaggcactatttgtttgagttttatcaagtttaatttcttgctgagttgctttggtaagtgagctttcaccgcttatcacttcgtttagccaacgtttaaattcataacgagcaaagtattcaatcaattgatcttggttattttgccccaacacgagttgatccggtgtaatatctaactcaacgttggtttttattgttgctaaaaggtaagataaatccgcatctgccttggcggaggatagtttctccccgagtttttttgctcctctaactgataatccagccactttttctaaatttgcataaatttccgccatactcccaatgccttgcaacaatcccaatgctgttttttcaccgacaccgctaactcccggaatattatcggagctgtcgcccattagtgctaaataatcaacaattaattcaggcggaataccatatttgtctattacaccatctctatccagtaaactgttattcatggtattgatcaacataatattatcatcaaccaattgtgccatatctttgtcgccggtgctaattagaacgttttttccctgctgagaggcctgaaccgctaatgtaccgattacatcatcagcctcgacaccttcaacagacaacagcggaattcctagtgctttgataatattgtgtaatggctgaatttgttgacgtaaatcatctggcatagggggacgatgggatttatattgttcaaatatttcatcacggaacgtttttccctttgcatcaaatacaaccgctatatgggtcggttgaacctgagcaattaaactttttagcatattcaatacgccatacattgcacctgtcggttcgccaagagaatttgttaatggaggaaaagcatagaatgcacgatataaataagaagaaccatctacaagaacaagcggattttcagcaattttagccataatagaataatctcaaataacacaaagagcggttattatagagcaaatttttgagggaggcgaatttgaaaccggaataaacaagactgaaaagaatatattttaagcaatgcaaaataaatccttagacttacgcaacttaaagcaatacaatttcccatcaattttgtcgatgtttttaaccgcacttttaaaccaaaagatcttatgaaactcaatgctcaacaacaacaagccgtagaatacacacaaggtccttgcttagttttagccggtgctggctccggtaaaactcgggttattattaataaaattgcttatttaattgagcattgtggctacttaccaaaacaaattgctgctgttacatttactaacaaagcggctagagaaatgaaagatcgtgttgcacattcaattggtaaagaaaaaacaagaggtctgcttgtttcaacttttcatactttaggttttgacattattaaacaagaatacaaacatctcggttttaaagccaatatgaccttatttgatgaatatgatcaaatggcattattaaaagagattacggcagatctattaaaagaagataaggagctattgcaagagacagtttcggcgatctctcgttggaaaaatgatcttattcttcctaaacaagcgttcactcaagtaagagacagcaagcaacaaacttttgccaagtgttatgagcgttacaataatcaaattcgtgcctacaatgcattagattttgacgatttaattatgttgcccactttattatttctccaaaatcaagaagtgcggtctaaatggcaagaaaaaattcgttatttattagttgatgaatatcaagatactaatacaagtcaatatgaattggtgaagttattagtcggtcaacatactcactttactgtagttggtgatgatgatcagtctatttactcatggcgaggtgcacaaccgcaaaatatggctcggttaaaaaatgattttccacaattacaagttattaaactggaacaaaattatcgttctaaccagcgtattttgcattgtgctaacatcttaattgcaaataatgatcatgtatttgaaaaacgtttattttctactttagagcaaggtgaaaaactacaagttttggaggcaaaaaatgaggagcatgaagcggagctggtcgttggagaattaatcacccatcgttttatgtataaaaccaattatcgtgattatgcaatattgtatagaggaaatcatcaatcaagactattcgagaaagtcttaatgcaaaatcgaattccctataaaatctcagggggaacttcttttttctctcgagcagagattaaagatatgatggcttatttacgtgtactgataaatcaagatgatgatgcggctttattacgtattattaatacacccaaacgagaaataggctccgttactttggcaaaagttggaaaacttgctcaagaaaaacatattagcctttttgacgctatttttgattttgacttaattcaccaactcaatcccaaatcctataatgccttacaaggctttgcatattggattgtcgaactcaatgatgaaattcaacgctcagagcctgagcaagcaatcaaacgaatgttggcacagttacattatgaagaatatttatatgaacatgccaacaaccctaaaattgcagaaatgcaaagcaaaaatgtagccacgttatttgaatgggttgcagttatgctaaaaggagatgagttcaatgaatctatgtctcttagtcaggttgtcagccatctgacgttacgagatatgttggaacgcaatgaaactgatgaagaaagtaatcaagtgcaattgatgacattacatgcatcgaaaggtttggagtttccacacgtttttttaatcggaatggaagaaaatattctgccacatcaaaccagtattgatgaggataatgttgaagaagaacggcgtttagcttatgtaggtattactagagcacaaaaatctctcacattttctttatgcaaagagcggaaacaatttggtgagattttcaagcctgagcccagtcggtttttatctgagttaccccaagatgatcttcaatgggagagaaatgaaacacatgcaacagaacaagaaaaaaaagaaatgaaaaatgccggatttgccagtttaagggcgatattaaatcaataatgctacctattataaattttatacctactttgtagataaatcagacaaccaaataaattttataaaaaatcgtttgacttatttttagaaaaacgtattataccgcccacaaaccgattgaggtgagatggccgagccggctgaaggcgctcccctgctaagggagtatggggtcaaaaactccatcgagggttcgaatccctctctcaccgccatttactcagtgcatccgtagctcagctggatagagtactcggctacgaaccgagcggtcagaggttcgaatcctctcggatgcgccatgttgatttttgattttattgaactctacaataaaacgtacacaataatacattcggttaaaaatcaaactaatacgcacccgtagctcagctggatagagtactcggctacgaaccgagcggtcagaggttcgaatcctctcgggtgtgccatcgacaaaaacccctgataaataaccatatatagccccttgcgatctagcgtgataattgcttgaaaatcaagtattttccgcatattcaaaaacaaagtattgtatttatatacagtataaattatgatctaaaagaaccgattacagaatttaactgttaccaaaaactgatccaaaaacaaaaaaagtgtaccaaacaaagaaaaaaggggggatgaaatggcaacttaccaaaaacggggagagaaatggcgagcaatagtccgcaaaaagaacgttctaaaaacaaaaacatttcgcacaaaagcacaagcgttcgcatgggcaaacaaaatagaagcggaaataatggaaaatttatatcaagaagtggctaacatccctctagaaaaagtgatagacagatacctaaacgaagtcacaccacaaaaacgaggagcaaaaaaagaacgacaatttctctaccgtttccaagcattacccatcagcaaaatatcactgagacacctaaacgaagacgacttcaaacaatggcgagatgaacgactaaaaaaagtctcctcagcaacagtattaagagaatgggcggtcatcggacacatactaaacgtcgcaatcacagaatggaaactactcaaaaccaacccactaaaaggggtcaaaaaaccgaaagcccccaaaccaagaacgagacgctacagccaacaagaaatagatgccttagtctatacatccggtttttcttggaacgaaccgccaacaacagcgaccgcaagagtaggagcagcgatattattcgccatagaaacagcaatgagggcaggagaaatagtcaacctaacatgggaacacgtccattttgacgacaaaatagcccatctcccacaaacaaaaaacggctggtcaagagatgtacccctatcaaccaccgcaataaaaatattaaaattattggaacaaatcacagagggagaaagcgtatttcaactaacaacctcaagacttgatgcattattcagaaagctaaaaaacagaataatggtagaagatctccattttcacgacacaaggcgagaagcactaacaagactggcggaaaaagtcgacgtaatgaccttagcgaaaatatccggacatagagatctaagtatcttacaaaacacctactacgccccggatatgaaaaaagttgccttattactggattaacgttttgctcgttgacgtttacgagcaaacgcaatcacatcgcctgcaatccaacgattagcagaacgtccacccgtgcgacattgcaacttcaccgcatccggaaaatccggatcggacataatagaacgtttcgtatgctcatagctcatcttaaaataattagccacatcttgagccgtccaaatagcttgattagtttgcgtatagtttgccaccttcaacaactcacgcacagcttgcaactcccttaaaatatcctcattggttatcgcttctttcatcgcttccataaaaatttcctctaaaattccttaatttctctaaaaaactcggctcattatgctcattcccataaaacgaacgtaaaggcacagagtgatctgaaataaacacctcatcattgataagtttcaccgatgtcatcgcattcaatctaaccgatctacctttcaacaaatgattaattgcatgctcattcaacggtttcccaattggtcgtatcgcttcttttattttttgaacaatttcctcccttcttactaaattttcaaggttacagttactgacacaagtccaaggttgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttggtattgattaacctcgctttcctcataatgcaaacacaacggcacatccttacgcaacgccaacggacccccaagacgtttcataaaagcggcataatcgccaatatctgcacaaattcttgcctcttcaaccaattcatcatcagcttgaccggcaacaagacggcgtaattcacgccacacaccgacatatttatccccataaaattgaaactgacgaataccccaaaggctcgcccatgctctcgcttttttagcattatcttttaaactcatatcggcatcttcatcagaccgctcaccatctaaagcaaaaccattaatattttttgaaatatacttagcaatataccccgttgccgagcccttagttttatcgcaatcttcgattttacagcgatgttttttagcccccatttcatcaccgtcaagctccaacgctttttcacgaaacaatctcaccacctcttcacgatgcgtctcatggacataaaccaacaaatgccaatggggcgttgcgtcatgatgaggttcagcgacacgcataccataaaaagcaatattacgttttttcaataacgccctgaattgcccccaaatcttattcaaatagtcctgcgtttgcttaggattagcccctttccatttcttattttgcgtaccgtcattatggattgcatggaatgatgaaggggcggtcagcgttaaaaacaacgcatgatgatcggactcctccgcccactcctccaaccctctcaaacgggtcatcaactcaatccgacgctgagcaggattcgcagaagatttcaaatacatatcaaacagctcagcttgctcactcggatcgtcgatattctcaataatcatctgtttcaaaaaatcatagtttttcttaatctcatgcaaatactcagaaaaaccggctcttgaaatataattgcttctgcgtttgcaaacctcgccacaggcaatcgcaacatgctcaaccatctttttctgcaccttccgcatacgcttaaaccaatatttctcacaaataatcttatgaaaaaccgtatcaatataatccaatctaaccggctttcctttcttaaacttatcccaatgtgaaacaggaaaaccaatattttcacaagcctcaccgcataactgataaatcttccgcatatgctcattaaactcatcatcgcttaaatccgaccgccctttttccaccaaatccaacatataaccacgctgaacattagcaaacagcgtagccaatttataagcaatctcctccagcttcttctcgctcaacaaataaaaaggcatttttgcacgttgacattcttgacggctataatgctcaaaattcttgcgtaacttcaaaatctcatgttgctcacgcaacaaccggctttcatattcctccggctcgccggttaccggcaataaatccccattgtgcggttgttttttttccaacacatcaaaggacaaatccgctaaccatttcggatcacgctcatcaaacgccaacaaccaagccatattgcaacgatactgatcgaacacaaggcgtaaacgagtacccaaggtttcacgcaaccaagtattagcatgtctacgttgtttattcccgaaagcaaacgaaatcgacccgtcatcctcgacagaacgatactcatttaaatacaaatggcgaaaatgctcacgttgtcgttcacgtggcaatttcgccaataatttctcaacaaacacatagctttcgggaacagtattaaaaagctccatctgagcttgtgtccctgttttttcctctttatgaggaacacgaggggaaacctggaaaaaaggcaccgcagtttccttttgctcgtttttaaataccgtcacgaatgccataaaagcctactcaacaacttaaaacgatggcggaatatgagccttcaactctcgcacttccgcataaatcgcctgcaacacattgagaatatcaaacaacgtattcacatcctcattgcgtaactcacaacgaattaacgcctcaatgacatcctcaaattttctacaacacatcacctgccgagccgagctacctttctgctccaacataaaaaccgctttttcgcccggctcaacctttaaaatctcataaacaccctgacgaattcgtaacaaataacaatcagaaagctcaaaaatataatccgtcatacagaccccttcacaataaaatcacgctttttcacccccgcatgatagaacggcaaaagtgcattcaacgtactaaaaatggcatttgaaatcttcttctgcccggattcattaaaatgtatcaatttagaatattgataattcaacggatcgaccaaatccgacgtctctaatttcgccttatcaaacaacgcatatttctgctccatcggcaaggcatcaaaaatacgctcggcagcattaggcgactgatttaaaatacgccgcaaagaagcaaaccccgccttagaaaccgcctcatgatcgggtaaccgctgaacaataatgctctccacatcaaaatgacccataactccccctcaagcctagcgagccaaaaaatcccaaaacgacgtcaaaaaacggcgaacgcaacctggtttcggcggttgttttttcacagcgggcaacacgacacgttccaattcgcttaaacgttgcaaaatttcctcattagtgatttgataactttgatgaagctcaatatttaccctattcatttttttttgtatttcaaatttacgttcaatatttgccaaacgcttttccatcttaaaaagattgatacgttttttattcattgcagtacatttttgatgaaatttttgtttaatcatgttgtgtttcctcatatgtgttgttttccatttrkgcraatrtgattgcctactgtaggggcggattacatccgcccttttttaggttgcaaaaacccacgccattaaaaaacagcgattttttatctaaaaagaaagaaataatagattacgtgtcttcgtcgattggacttgcctcaaacaaatccttcgtatttgtatcactttgtaacaacggtttattaatccgctttacctccggacgctcatgataagtaggcgtttgcaccgtcacaatttcgctataaatatgatgtttagtagaacaactattacaaacccaaattgcctcaatcaccaacataccgacggattcagaatgacgaacccgcatactatgactaccgcaattggcacacttatgattcatatttgccatctttacgctcccagcattgccgaataacctcccaatccacatcagggcgtaaatcctcgggcgttacctcgccattagtcgccttgataagggacgggatatatttcacatccatttttccgccgtttagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgaaactcgctcccctaaaaatatagttgaaatagcgaccgcacttggcgttgatgtgcattggttaaagacaggcgaaggagaacccaatattacgcctcattcttctatattggtgagcaatgaacccgacgaaaagcatactcaccgcataaaccgatatgattttcaactatccgccggagacggaatcattaactcggattacccggagaccatttcgagcatttggctcacccctgaaggtatgatgcaaataatcggacgttatagtgaaaaagggatctgtatttttaaagtccccacggacagcatggaacccaccatctcatcaaaagacctcgtttttattgataccaatattacctattttgccggcgacggaatttatgcctttcgacttaacggcaaagactacataaaacgcctccaacaactccccaccggcataatccgagccttaagcgacaacaaactttacgaccctttcgacattacagaagaattattcgacaccgcagaaatcgtcggaaaatttatccgagtcgtccccctcaacccaaaggatttgtaggggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccattaatatccaactccaattctaacgaggttgtaaatccgcttgtggtgagattatgggtaactttactgataatccagcgactactgtcaatctgatctttaaaccctcgtacttttacacgcaattccggcataagcaaagcattcccatcagctaaattaatagacaaactcgcaatcccccttcgcattttgtcaaaagcagctttagcagcattgatagcataagcttctgttttataggtatgtctcaaggttttcatcttattgctatcggtttccaccggttgagtttgaacaagcgtaacttttttcttggtttttgaggtttccgtgcttgttccgccttcctctgtggggtgtgtcggttttgccaagcgttctattttggtatttttatcaattaaaaccacgcccttttttccattatccatattatgccaataagcacggactgccgtataattatcgttttctgtcaacgaaaaagaaaaattgtcgcccatctgccttgtaatctcaatggtcggcaaggctttaccgctcacagtcaaccccattcccaccggcataaataataatttaccgtttttcaccgtggcaatggcatcgtaattttccgctaaacgacttaacaaattaatatcactttcattggtctgatctaaatgcggaatcactttttctttaaacgcctcggcacaagccccctcaagttgattttcttttgcaatctgattaatcaaattttcaaatgaaatattatcaaaggaacgttcttttttatcgctaagtgagcctctcaaatccgcacttcttgcacgaagagtaagactatccggacttccgctatattgcagttcatcaacaataaatttacctttagggattaattgctccccttgccaaccaatggctacttcaagcattgcaccacggcgaggaaacgccaatttcccatcatgatcacttagctgaatatcaatttcgtccgcctcaaatcccctgttatcagcaatcgtcatcgacattaagcgatggctaattagcgtagtaatgtcttttttgttttcatcttgcgttatcaccctcaagcgataatgaggaatccgatgatgatttgctacagtgcggtctaaaaattcagaatagctcatagttcaattaaactctttaacgtatcgccaatatcttttaacaaactttcgtttgtccgttttaacttcattgaaaaatcaatgcgacgtgaagcaccgtccgcaaaaaaataggatttcccgacgctaatttcctcaatgacaaaccagcctaaaacaagaaaagtactcccatcaattaacggcaagggctccccctgttccgctaaggtttcaagggcagtaatactgagagtagatcccgtaatttcaggcattaacacgccattaatggttaatgtttcgctatcctttcctgtaaattgtgttttgggtaattcccctatcactgaatttgtcggatgtcgccacgtaatagttctttgtgtctcctgataaggtatcgttgaccgcataaaaacaaaaaaaccatacgccatcattgcattagattgaatcattgcttttccttccaaagggctaataaaaagcggtgaaattcgtcaaatctcaccgcactttttacacatctacttggcttctttctcttgctttttcacgccacaacatcaattccgctaaatccatttcatcaaatacagccggcgaccaatgaaaaatagtggcaatatccgcaatagcgtcttctacgcaatgaggaataactaagcctgttgtgtcgccgttgtattctccgtcgtatcgttcgtttccgttttgacgaaaaaaccgattacctccgaacaaagggcggtaaaatcaatcggatcaaggtttaaaatttccattttccctaaagacggttgcgttacacgtggcaacagttggcaataagcgtcaacgtccatttgcattacatcaaacatcttcaagcctttaagggcattaacatttggcttaattaaacgaatttcattgatttccgtttcgccacgttttaacggctgaatcagtgtaacagttttatttttcatctttttttccttacaattcctatacgattataaaccgatggctcggcgatgttcttttaagcgatctacaccattgacaacaaaaacatgattaattaaatcaatttcaatcagcgttttaccgttgacgatttctttgtaatacgtgagtgaagccttaaaggtttcttccgtatcatcgcccactttcgcattacccggatcaatttccgtataacgcccacgcataactaattcaacagcggttacttcgcccgtgtcatcacgttgataagcctgcgacaaacgcaacagtacgccgccaatttctgccgaaccgaataaagcacgcatattctccatatgcccaccgaattttaattcagcctctaatttttctaagcctaaattaatatcgacttcgcctaacatatcgcctgcacgataactttccgctttaatggcgagtttggggcgagtaacctcgttgacttgccctaaataactttcgccgtcttggtgtaaattcattaattttaatttattgggtaaagacatagttcatctcctaagcagcagcgactttagatgcaaattcagttaaataacggtcggtaatacgttgacggaaatttaaattttctaacggcggtaccggtgtatagtcatagtcaatatacaaacgccccgcttttaacgtctctttgctattaatctcagcgtcataccaacagctggcgtcaacaagatagcctaatgcgacaagttccctaaatttcgcattcacaccctctataatgtctttcactaaggttggggtcatcggcttatcaattgcccaggcgtgagcctccgcaatcgtatcacgcaaaatttgagcggtacgtgtatagttttcaaactggaataacggatcggcagaacaagtacgagacccccacaaacgataaccattaaaattaatcggtacagtgacgttatgttcattcaggtaattggcgtctgtactggtatcttgaatatcaaaggtaatatcacgactcaccccgctcaccccctcgacaaccacattagaaatcgttttatgccagcccatagttttatctaaatacgcacgcaatcctaacgcacgagcaaccgcactttcattttcaaccttcttactattaacatcaaaagctaaaaaatcaccatgaataaccataacttcacgctgtccaaatcctttttgatattgaaccgcttgctctttggtttcgcaaccatgagcggatatatacgcaaacgcatttaactttttagcgacgctggctaattccgtggcaacggctttattatccaagtaaggcacacccaaaatacgaggttttacgccgattttactttgggcaactaacaaggctttcatacccgtatactgtcctttttctgttaccgtaccgataatatttgccgtggtttgtgcattatcagtttcagtgtcgctgacgctttcgtcttggacatcgctctcactatcgccaccgcctcttctcgtggctttggttttgctttttttgccttcttctacacgcactacaacagtcaacgtattgacctgatcactaattgcttcaagggttttcgccaacgtacccgtcttgcccgctttagcaatcgcagtcaacggattcgttaataaaacaggggtattaagtggaaacgcttcactatcagcatcatttgcggtacaaacaacaccgataaccgccgttgccacggtttttattgtgcgagtaccttcgttaatctcaataacacgcacaccatgcaaataatccatattaaaatcctttcggttaagttaagggaaatttcagacatcttaggaaatcttaggaaatctcagctattgtgcaaggtcaaaaaagagcggtctagtggcttgaaatgtgaaaaataaattcacctgcacccgctaagaattcctatcgcattgacaaccataaagcgtacattataatgtacataaaaataaaatagagaggttcctagatgctaaatacaaatatcacgaattttagaaaaaatattttttcactgttggaacagacgattaaatataacgaaccggtcaatgtgagtacgaaagacggcaatgctgttattatcagtgaagaagattataacgatctgatggaaacactgtatctttcttctattccaacgatgaaagaaaacatcatagagggattacaaacgccacttgatgaatgcctgtcagaaaacgaggtacagtggtaatgtattccatcgtttatacgaaaaaagcagctgatgatatacctaagctcaaatcggcaaaattggagaaaaaagcgaaggcattgatagaccttatccgtgaaaatccctatcagacacccccgccttatgagaaactgctaggcgatttacaaggggcttattcacggcgtattaatattaaacaccgccttgtttatgccgttttagaggaaaaacaaacggtaaaaataattagcttgtggacacattatgaattttgagaaatgaagaaaccgcccttgttgagagcggtaactaaaaggaacgggattatgtattttaagttgttaatcctagttatcttaatcttaataagcacgccagcttattagattagaaggctaaaagtcctggcagagactgccatctctgctaggcagttcctaaatactacaaccacagctattaaaaatcaacaatttataggaaaacactatggcaatgacaaaacaagaaattcaagcaaaaagcgatgctaagcgtggtgttcggttgcaatcctacaaacttcacgaagatattattgctctactttctgaactatcggagcaaacaggactttctaaaacccaaattgtcacacaaggaattaaactgtttgccgaaacaaaaaaggtcgcttagtgttaaatccgtttaaaatcagccactatttgagccaaytgattaggattaaaycgccagcccttttcgcttctgaatatggcattaaaacaccattccgagcaaaaraatttacttttcttctcacgaaaaccyaatactaagccaaacacgccttgccaatcatagttagccccttttgtcttcttaaaataggctttsacttgttcttcagtgagattatcaagcggaattaaatcccatttttctgtcttaagkgtcatttctttttttcgcacaccrccatcacgaggrcttgaactgtagcaatcgtaggtgatatayggataataatcgccacttaaaaacgccgktttttctaccgcaatttcacaatggctatattgmcccttcgtgatgtgacgaataagcccatctgtaaatcggtcatagagrctaccgcctcgccccttgtacagagctaaatacaccttactcattgcyywrctccttmawrtastcsysataactggttgtccamccgycsgaataatcatattccgccggattgtccgattgstyyayrgcgkttttatgtttyaasgcattggcrtgattrcykgtyttrgcttkcattaasgcttgccaaatcagcattaatttttctttgttaatcatcaatacagagttatccgcacaagtccaygcaatttccatatcaccgaataaatcataactggctttgacggataagatattccgctccgccgtagcgtccgtatcaatccacttgcccaccgcttccacaaacaccccgccattaattttttcatctcgcaaggcattgattttctctcgcatttccgcccgcacttgggttaaatgtgcggtttgattttcaggcgaaataacccactgccccttttcaatatgatgaaatggactgggttgcggttcggctaactgcggataaccgttttcatctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggcgaaaattgcacgaaaatgccaagaattaacgcattttcctttttgttctaatgtaaaagcccttgttaatcatcgttacccctatcnnnnnnnnnnnnnnnnnnnnnnnnnnnnnnnnnnnnnnnnnnnnnnnatgatgaatattatttccattgaagaggtgaaaaaacgagatgaacgcacttactaacattcaatatttacatgatgaaagcggacaccctgcttttgccgtcatgcccattgctacccttgaatggttaaaacaacaggcaaaactctcctctcctttagatagtggcgtgccttttgctgtagcgacttttgccttagaaaataattgctccgcacttgttgcgtggcgtgagcatttaggattaacgcaaaaagacatggcaagccgtttaaatattactcaatctgcatatagtcaatatgaaaaatcatctcacttgcgaaaagccacaagggaaaaatcgcccttgctttaggaattcatgcgacgcaattggatttttaattgtcattatttgtcctctttccaacgtccgataacaagccattctgacttacccaagtaccagttagtgataattgcttgggtatttgtatccgcggtcataaatatccagttatattgtccttcaccactcgctctatcttcgtatttttctgttatgaaacatcggtaatttttatccacaaaggcaattggaaataccacgtgatttttcacggtataaccttcacttttatgagtgaaaataccagtctgaatcatcgtaccatcaggatatttgcgtacctcaacatcaccgattttttgatagctaaactgagaggcaacggcactgttaaaatcggtaatttggctagctgtgtgcaaatgccctaaatccgatttgccctgcaacgctacagcgattttacttgcgtccatcattccagcattttccaccgcaccgaatgctttaatccaaaattgtacatcgtcaaaggtatttttggctttaatgcacaatttgagaacaagagacttaggacgagtttcttcggcacctgaatagaatattgctccgttagtgcggattttataattatccgcagttttattattcccagtagcaattgtgtcattattgtctacatggtactgataattacttgaattatggtttgtgccataatttaagtaatgcgttttaattgcatcctcttgtaccctccccacaaccagctcatttgctgcattacgcaaaaaacggtcttccgctttgggracrttktswataccgscrtatttttyartyaggtatttatryaaytcagggtatktwtcttsykttacytyktcyytgatttyrtcaaackcaayccarccmtywggratatyrtctgtcgcaaaatacgccgtcataccgacatctgagcgagttaaattgggtaaagtgtttttatcgcctaaagtgcggtataaatccgggtaggtkckttggtcaatagtcgwyccatcgcattttaaaaagccrgtgggattwktaaywkctttyggaaacgcyacaatcgcccccaaaggcacaccatcaccgccsaymkmtttccaykcygtccawyytgarccrytaaaaaascgwgttttgackyykgtatcrttsgctttgcgtgcaatttgtcgcacggcggtagattgyccaccgctcaccacttcaacatgccaygcwccgttgttgtcgggcaaatkctgacygctcgcaaaataataatgcccgtckgttttgtaattatcgacatcgtccgaacctgytttaacctgaaaatcggtaatgccgtagccwgataaagtggtctgtttcgattgtttgctttcagcragttttcttgcgtcttccgctttgtcgtaggcagttttracsgcttttgatgtagcgacagtatcggagctattgctatcsgttrmrtcsgatttttkgttgttwggratatattcctctagcttttttgctaactctttccccgctttagcggttaaggcgagtgtttcgctgtctgaggttgtctcgttggtcagttgcacaataccttgttggcttgtactcgctttggttatctcgtgagtatgtccgtcttcatcaattttattttgactgttgccattaatggttttgggttgtagctgtcccgttttcgcaaaaataacgttattatctatttttaattcaaaggcgtctgatgaggataccgccaaaattaagcggataatttggacttttccgctaccgcttgataattggggtttaaaactttcagggcaattggcataagcaactaatttatcgttattgtcgaataagccaatttctctaatccaaaaaccgccctctgtttcagggatcagtaattcaaagataacttgctgatgatttcttggatctaccgatattgcacttacattattgctataaactttgttttttaattttgttgcgtttttatccggcgttaccgcttgtccgttgccgtcgccgattgccatttttaagagttgtaagggttttttgttggcaatggctgaggtaatgagctgttccccatgttgggttaatacggaataataggtttttgtcatttcttttccttatttggtttaattgggttatttaatttaatcgggttatggataaacactgataatttcgcccatatattgaccaataaaatgatgtaatggacatttaggcgatatagaaatagctaactgtgttaaatgtcttgataccggctttgcatcatcaacgagacggaccacttcattgtaggtttgttcattcaatccgctttcagcgacttcaatcgtaatgctgaatgtgcctggtgtgccttgtgggtgcagatcaaaccattctttgacttccaccaaatagccgataggctcaaccactcgacgaatagcactaatcgtacctttgtatttgtggattaaaaaagcctgttgaatggcaatacgtttgacttgttctgtccaatgctcatcccatctatctacactgaacgcccacgctaaatacggcaacagctcaacggggcaacgctgaggattgattaagtctgcaataataataggattgcggacagcaaactgtaacacttctgacgctttacgctccagctcgctactgcctaaaggcaatagtgcggggacggttgggaacctgtcatcaataatcatctgctgtcaccaattcaagtgtaattttttcacaaaagccggcttgattattctgtaatacaatatcggcttgaggttgtagtaattctacacgttgcaccccttcaatatgcaaggacgcataaataccggataaggtaatatctcgtcctaatcgctgtttgtcttcggtgtattttttgattttttcctgtgcctgtttgttgatgggttcgtattccggtcctctgtagatgtgcagttttgcatgaatttgataccgatgaatactggcactttgtaccgttactctatccgctattgggcggatattttcatcattcagttttttggtcaccgcatttaaaaccgcctcaccggcttgcccgtccccttttttggctaaaatagtgacagtcacattcgcaggtgagggcgatatcacagagacatcggcaacctccgcatgtgcggataacgcatggaatacataagctgcacgaggtcccgccacagacaacccctcaaacgctaattggcaacgcaaacgtaaatctgtgtcgctttctcgtttttcttctattggcggatttacgctatagtccgctttttgtatgatgagacgctgtacattaaaattagctgctatcacatcaagatcgctccctgttgcataagctaacattgttgcttttgctgcttcgttaatgcgtttgcgttctaataactgcaaataacaattttcttgtaataatttgttaatcggttcactttctaatgcgagtacggtttcccaataggcttgtttttctttagggtagagtgctataaattgagctttgcgttgttttaataactgttcaaaatcaaggtgttctaatacctttggggcgtctaatttcgataaattaactaattcgctcatgccgtttccctaatatgatttgattaaaatttatttttttgttgtcttttttgcggataaagtccatattggcggtgatttgtgctttctccggcacgatatccactttaaaacgtgtaatttcaattctcggctcccattttttcaaggcgatcactgacgccgtggcaagttgtaacatcagggcttttgtgatgggacggtcgatcagctcaaaaatataactgccatactctcggcgttgtattctcgtcccaatcggcgttaataaaatatccgtgatagattgttttaaatgggcgttttcgttttcgcaatatctgcctgtgtgtttatccattagttaggcactcctgtcgttccgccactgtcgccagcgtgtgtatgcgtttgtagcgatacaccaccggcggtaacatcgccttgtgcgttaatattgcctttaacacgtattgacccttgtacatcacttgagccttgcacactgcttgaccctttgatattgacgttaccgtctatattcatatcttgcgtacaatgcactaagggcgtgttaagcgttacgctgacattcgcttcaataagtgcggttttaataccgcttacttttaattcacttgtcgcttggttgtattggataatggcattatccgcaaattgaattacatgctcatcaggcgaattgctcggggtgttaaattccaacgtgtagagggcactcaaaataaaaccgctgtttatttcacccgcaggggaaataagaatacattgttcacccggtgtaattggcgaccaaattttggttgtaccggcacgtgaagcacaccacggcaaccaatccgttaagatattacctgtttgtactttggcacggcgtttttcgtggttcacttctgccacgacaccataccgcacaatattttctaattttcggttaaattctgcttgcattgcacattcgcacattcttaaataaagtgcattttgagaaatttaaccgtgtttgagtagtatgccgggttgttaagccggaaataacaaaaaataaaatacattaaagggcggatataatccgcccctacagtaggggcgaatcacattcgcccaatcacattcgccaaacaaaagtaagttgattaattgttattttagtaacaggttacatcgtcggagttgaagtcattcagtgaaagtcagccaatccaaacggtaggcattttcacgaaaatgtttaaccgttaaaatcaaaatttggttattgggttcgtcatgccaaaagagatagctataaccactttttctataagagacaaaaacctctcttacatttttcaaggtcttgccatctaccgacaaatcataggctttgccgttatttggtctatcttggctagcaacaaaagaattttttagcagttgcatgactgcatttgcttgctttgttgctcctacgtcagtcaaaaagttataaattcttgttaaatcagattgagcaagtcttgtgatgatgagctttacttgtgacatgggggcatatcctttggttcgtctgtttctagactgtccacccaatccataaactcacttagcgtaatatgcaatcctgtttcctgataatcttggtaggcttgtatagctcgtctatcataggcttgtttagcttttaagcgttcaatgtggctatctacggcatctaacacaatactgtgaacgctaccgccaaaatcttgggctaattcttgcaaaattgctttgcggtaacccagttttacgctggttacttcttgattggcaagcataattaatttcctttagaacaagagaacaagtagtcgctcatagtaatacaaaagtattactcgatcaatgaaaagtcttcggaaatatgaggtttattgcattgacatccgcccctgcctaacgtcggggcgaatcacattcgcccccaattaattaatctctgtctcttaaggcggatcgcatgcgtgcttgtttttgttgttctattttaactagggctttctccacttctcttgcaatatcttccgcacgttgtcccgccgtggcatgaatattgattgtcacttgcataggttgaggtgtttcttgcaggtgatgtgttgttggacttaagggcggtcgattatccataacaaaaggctgtgcggttgcaacgcttaatcccatgccggcggtcaacatggcttttttgccgtagttgagggcattgagcaacggtacgccaaggcgtgatgttgcctctttggtcataatatattctccgccgtgaaatatgcccataggctgatattttccaccgtttccggcatatccgcctgaccatttattcaccggcggaacgtgattggttgttgtttgtgtggtgaaggtggcttttgtgtcggtgtctatgccgattttttctttaaaccacccccatactgacgaacctacattgctaatagtgtcttttactttgccgagggcgtttactatgcctgaacttaatttttccatcagcaagctaccaacatcagagaaattggcgggcagttcaacaccaaaataatttaacacggcggaaaaagctttgtagaataatccgataggtgaccaatctataatcaacttgctcacgccgccaattccgccgttaaaggcttctttgatgtgttcccaaatgcctcccaaaaactgaaaaataccgttccatacgtggaaaacaatattttttatactttcccatacctcgctacaagccgtttttagccattgccagcctgcaacaagtgcagcaatgactttatcccagtttttccaaagtaaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatataaaaagacaataacgacaaaaactacggtggttctatgaaaattaaattgactgttaatgattttattgaccttatttttgttttaattgtctcgtgtccttaccttatttgttatttttattttgatttaagcgttgggctgacatttatttttggcagtgttgctttattttttatttttgtgttgttttatgatacgtccaattgtgataaaaattgttgccactgcaaaaataagaatttagatgatgacatctaatcaatattttcactcaatgccttaatcacaaacgcttcaatcatttctttgtcctgttccgtaaagccgagcaattcacgcttggcgtattgtactttgtgttctttgtgtcgttctactcttgctcttaatccatattgatgaatagtggcgatgtaggcggtatttccgctaaaccctagttctataccgtctttttggcggcgtagcttcatgtgccttgcttgggtgatttttttaaacatggcttgggttttaattctgcctttttttgaccgcactttttgcttgcgtggttgataggctgaaccgtccggattttgctgtgctttaattcgtttgcgttgactgcgtgcgagttctcgtccgatttgttggtaaagcagtcttagccgttttggtgaaacgtttttaagcagacgttcaaaagcggtttttacctgtagcatttcatccatgttgtagctcttttatttttctgtctttttttctatgatttcttggtatttttgtgagcttggttcatctagatgtgtgatgatattttttccgttctcttcttttaccgatattcgttcggtgagttttaggaagatggatagatctatgctgtcgtggttgttgtgatcggcgataaagcggaatccgtcttttcttttgtccggattatggattaaatcaggttggttttctcggataaagtccataatcggggcaaaaatcatattgggcgatccgttaaaatcacgtacgataatatttaatgtgtattgcaattcataggaggaagatgtcgcaccggcactaacgacaaccccttcatcaatgaataattccaatttatcagggttggtattgaggtcttttgaggtgctttgtaacaaactgcggataagctctgcttttaacatgttcttttccttaactgattgacgagtatctataaatacgttggtgtttttcgataatgcgttgacaatctatacaacgacaatagccgttcttttggcgtatctccggtatttcttcttggcaatctagacagtatttcactgtgcttttttcccgtgttttttgttggtgtttttggatggcaagttgttgcattatttctgtgtattcgttggctctgtctacttgatcagtcatgttttttttcctgtaatgtgcggttgtagttttctatgcactgtgtaagtgcttgatttatcagcatacatttttctatttcattgagtgttttatccaaggcaacgacgagatctccgttattttttagtgttattgtcggtttttggcatagttgatctgtcgggcaaagtagcggtatcggctctattaatctgatgtgttcgttcgttgaacaggcggataatgcgattaggcacaggctgaccgctccagctctcatattgtaacgcttgtttaatttcatcagtccgtttctccgcttggtgtaaatgagttaagaggttgtcattcagtttttttacttgttcttgatagtggttgagttgtttttttgcatgatctaattgagcctttagttgtttggtcgtttccttttcttggttgaggatgttgtttgcgttgatgattttttgttcttttacttggttgttaaaatacaaatagccgttgatgctgataagtatagcaactgcaacgatgatgactttgtttaatgtggtgtttaaaaataatgcacggttaatcatggtattcacctaaacagagggctttttcttttgctctgcgtgctactaagccgtttaatttttttccgcctgcgtaaatccagcgttcaaactggtgacagagttgaggggtaaagccttggtttgcttgtttaaataaggtgcttttttgcatttttccacatcctacattaaaggtaatggaaacaaaggcatcaaacgccccttgcggtagatttttgccgtttccatagcggtttacgcattgttccgccaggcgtaaatcatatgcccatctttgggctatttctttgtcgctataacgttttttagggtcaatgttttttccgtttgcttccgtggagcctatgcccaccgttaagacgtcggcggggcagtgataggggtctcttctgcaaccttctacatttcctataaggtctaagccttgttgacttatgcgtaactcttgatggtttgctttgacaagggcaataatggcaactacgctacaaatagcccctgtcccccattttgtgaatttattcatggtcgccttcctttaagtcaatcttttgtttgagtgcggtttcttttaatttgatttctttgtttttgtaataccagttaatcagcatggtaaataagccaaataaaataccaaagatagctgcccagtctgccaaggtaaagccgctataaatggcgatggcagatccgacatacgcccctgttgtttcactattttttaacatgttaaacctcatttaatcccataaactcaatgtatttttgttggtggtggtttgtatatcttcactattaggcaagataacgacggtaccaatggcgaggattggtaagttggctaatgttgggtttagctccaatacgtgttctactaagccaagcgttttcccaaaataacgatagacaatgctatctagtgtgtcgttttgttttgcataaaccattcttgccattagattaactctactatcattctgtgttgtcctactatatcgcggatagcaaagcgtccgtcacgtcttaaatcatctacgctttgttcaaagtcctgtgctttttccgccccttgtttggtggtgtcgtatgagcgatagcgttcgtttaaattggctaaggcgaaacaatacaccgctcttttgtagcgttgtattacgatattttcgccgttgattttttcgtcatccatgtcttcaaggcgatgaatgtgtttttcttttagggttttttggtaatgttttaaggcgttgttagcggttgccatggcttcgataacttccattttcaaccgttcattcgttaccgttccgtctattcgcattgcatttcttacatcaagtaaatgaatatcagggaaaaagccgttgttttggattgtttcgttatctgttgcttgttcttccgcctgtcgttttaagtcgtccatggcgtaatttttgacttttttgatggcgatgctgttatacatgatgttcctttaactgtaaaaaagcgaggtgaggaaagtgatgaggcaaaaaacctttactttccgcctcgcttggcttgggctaggttgctctgtttcgtgttcagcggggattttcttgcgttaattgttttcgcaatttttttacatctccttgaacgccaatatttaaattcagttctaatgccttttccaagtaggctaaggcggtttgcggtgctgatgtgagctttaatagtccgatttctctataaagcctcgctctactttcatccggtatatcttggtcatcagtgaggttcgctactcgttctaaataagccacgtcaaaagggcggttaagtttttgtgcaattttggctttatcggcaaattcttccgctagggcagaacataaggtgcggttaaagttttcgggcaatactaatccttgatgtatagcatagtcggcaatttgtaatgcgaggtgatattgctcacagtctattaaccaaattagccatgtcattaagacgttatcttgtttgccacttgcactacttaacgctccctctatccaaggtaaataatccggtaaaatgttctttttgtagtccgcttttaacgccatagaatgaatttgttttaaatcctttttatggcgtgcaagaagatacaacattctttcgtattccgtcgcttcgctaagtatgcgttcttcttgcatatgtgcctttttcgctgaaacttctagaaaatgccttcttgttggacgcattcacgctttccttattcagcttttttcgctttgatgtcttcaggggcgtctatcatgttgatattttttaacaatgccacactttcatagttttcgacgacaaagtcatcattagaagaggtgtaatcttcatagcggtcatattctgcattatcttttaatgttcgacgcattgccccttcttggtaatagattgacaggttatcaagtcgggtaattaagatggtgccttttggtacaaaaggggcttgaacggcttgtaatccgcctactcgttttgtactcataataatatcaccggcaacttgttcactcgccttgctttgattgagcagagggaagtatttatcagccagcaaatcacggctcataatggcgactaatttcgtgtcatcttggaattgaggtgcgattaaatcgctgacagcagaaaacacaagggcatctaaatttttgtatgtttttccttccccgacttcaatttttccgctggactttttgtcttctgtcatgacacgttcaggtgcattgtcttcaatttttttcaaccagcctacagcgacatcttgtaataatgggtttgttgctctattagaggttgctgcacgacttgttccgttaaaaccgatcataattctatccagtgccatgcgttcggcttttaatgtgccgatgcgtttagcgaaatcagggaattttgcccacatatccaagatggcatatttgagatgtgtatcatagttaatttgttggcagtgatacggaattttgtttaacgcatgaatggcttgcgttttacgtcctgtcgcattggtatctgttgttcctgcaatggtacctgatacgcctaaccctaagatttcaccttgttgttcatctaccggtacaatgttgatcagttttaggaaatccgagctttcttgtactgcattttcaagacgttgctgtacacttggcgtcacattaaatttcgcccctcttgcaattcttgagaaatcctcttggttatcgtttgaaataccttgaatgtaattcattaatgtttgtgcggtggtttttttcatcgtgtttaagtcctgataattgattaaaagaaacgtccatcattcatactatcgccactaattaaagggcgttcggtatagttggtatgcggttttttttccaacgtggtaaatttttcgctgtgttcgtttgttttttccgtgtattcatttagcgtttgttttagcgtttgattttccgtttcaagtgcggtggttttttgatggagatgttgtacttcttttgaaagtaacatgaccgcttgatctacatcgctaaaacgttgctgatccgtccgctctttttggctaaacatggcagtaatacgttcaaataaacttggcttttccggctccacgtcgttaaattcaaatacggtttctattgcctcggtaaacaaattttctgtttttaatttgcgtgcattaaatggattggcttttgctgttgcagcaaactgtaacatttcggtccctaaacttgccgggttatccgttactgcaagacctactaaataggcttttcccgtgtcgctgaaattgatatcgatttcaattgaggtatacactttttgacgttttttgtttaacgcaatgagttcttctgtggggtcaatttgtgctaagagttgtaattttccttcgctttcttgggtttttaatgcgatgacatcaccataacattttgcgtgcggttcttcttctcggtaaagataagatttgatgtgatctaaattaatacgtgctccataggttttaggattgtagctttccgccatttgttcaatccaaactcgtgaaatattacgtccgtctgtggtcgccccctcggttgcaacaacaaaccattttgatttgtattttttcatgggtgtattcctattttttcttttcaatttgtttttatactggttgatttcttttttcttgtcatttgcttatcaatgttaatttttttttgacagtttacaggggtcatgcattttcttggatttccttattatgctgtgagtgagaattaaggatggatagatgattgatataacgttagacagtaagcgtgaaagccgattactttatttttccggctggcggattacggatattgccgacaaattaggggtgcctatttccacgatttcaagttggaaagacagggagaagtgggatgatatcgcccctgtcggtcgggttgaaaataccttagaggcgagattgaatttacttattttaaaagaagataaaaccggtcaggattttaaagaaattgatttgctgggtcgtcaaatggaaaaaatggcaagaattaagaaatatgccaacggtggcggtaatgaggttgatttaaaccctataaaagctcaagcgtttacctaggcaaacaaaatagaaatggaaataatggaaaatttataccaagatgtagctaacataccatttgagcacgtgatcgacagatacctaaacgaagtaacatcacaaaaaagtaggagtagagtgttccgaaataatcacatcatcattgattacttttaccgatattttttattcaccttaattattctacttttcaaaagattgtttataaaagaaagcctgttttcacaggcttcctatttatctcattagaatgttagctctgcactaagtttgaagttacgtcccggggcattgaagcggtttaaacctttgccggtgacgtaatcaattttattgcttgtaccaaattgtctaattgaacgagcagaatcccaagtgacatatttacgattagtgagattataaacaccaaattgtaagatcaaatttttgattggtttggcataagcgattacatcaaccaaagtgtaagcatcacttctccatctaatagagctgtcagtggtaacattagtattaccgatgttggtaggattagttattttttcttcattttgtgtttctctccacgtatcattatatgtatcagatgcttttttagcggcaacacgagttacatataaatccacaccaaatttaccatttgtattatgataacttagcccataaatgcttgtttttggctgaatagcattcattggagcggtaatattaataaattcatttgggtttgcagggtttaaatactctttaacttttactcgccctttttgcttactaaatttataactaaactcaaattcacttaaggctttatgcaaaatgctcaaatttaaacgagcgttaatctcaatcccactcgatttagcggattctctgtttatattttgtctaatttcatatggagttttaccaccatttgaatttttgtgatatccaatcgttctagcaaaatcaatgaagtttttatatttcgtttcaaaataattgaaggtaataaagccgaaatctttatagaaagttagtgcgatttgattcgttttagctaactctggttttaattgaatattaggtacaacatgcaaggtatctccatatttagggttaaaatcccccattttaaatgcgaaatatatttcatcggatgttggtactctaaagccttttgagtgtttaaattgtaatcgcataaaattaaaaggatctgtatttacacccaaagaataagaatgtgcagcaaaacttttttctttaacaaaagcatcaatatttgcctgatgacgagctaatttatttttctctgcgatttttttattttgtacaacagcttcattgtatgctactacagaatcatcatatttacttttttccttattatattcatttactttctgataaccataatccgaaaacttaggttcaggtaatttttttggtagctcgactggtttatatggatctttaaaatcatgagcgaatccaccgacaatatcatctggaatttttggggtgacaccggcagtatagctaggctgatatttaatttgatcataacgatagcccaactcgaaactaatacgatcattcaatttaaaatcatccgcaaaataaagggcccttgaagttgctttaacaggaactaagaaagagaaaatattgcttttaccacatagactagaataacttgttttacaattctctggatacaatgcccaccatttgacattgatagctgaatcgcccgattgattaaccatttctttttgggatttagacaaagagccaccgtaacttatattgtgatccgttttccctaatataagatattttgtgaaatctaaattaaattgtttggtgtttgtgttcaaagagcggtctgtccaaagattggtgttatgccccttagatgaaggtaaaaataatctatctgaatgtaatgcctcaccaccgatttttaatatcgctaagttacgctctttatctactttaaatcccaatcttttgggctgattgtgttcatcaataacggctattgtcgagtcaccatctctatctttgtctttggtatcacaactaatgccatcacaagataataaaagaggtgaatttgtttggtatttctcaatccacttactgttttccttgagagttaagtcagaataaacttgaccatttgaaattaattgctccgtaattattgttgcatatataggtatcctacacttatcagggtgttcagaagagatatctttataacaacttgttacactagtaggaacatcctttaaaactcctaatttttcatatttctcttttatatcatcaggtatcttctcgttccaagtatcaaatacatcttgactaacatattcataataagtttgtttctgatttgaatatttatatgtaataggatttccatctttatcaactagttcattatttttgttgtatttaattcccaatgggtttaatgagctattacatttatcattcccatcacaataatcttcatttctagctcttgttttaattttttgctcagaataagtaaatttcatcgtatcccataaaggattgctagaataattttcataagagaatgcatagttggttcgttttacctgatcattattatgacgatattcaagttcgggaggatcatttgatttttggagaccggttgcttttaatgtataggaaagatctgctcctttagagcgactatcatataaatcggcggtaacagtaaagcgatgattttctgtgggttgaaaagataattttagtaatgtactgtctaaatgtttgtgataaggatctgctttttctcttcttttaccttgtactgcagcatcaaaatggttataaccatagttctgtagttcatgaccatcacgttttgttttcactaataaggcatcaaaccatttataacgaccggctaaagtcatggaatctatatgctgacgatccgcactgttgtaaccttttttgtaagaaacataccagtttttctctgtgagaaaatctctagcgtctttagttttaaaaatgacagcaccacctaatgcaccgctgccaactttgagtgaattggctcctttagcaagttgcacttgtttcagagtttcaacttccgctccatttctcgtattattaaaattaccatagccttcaaataattctttaaagccctgagaactcaacgtttccgcttggtgtaaaccatctatcgtaatggctactcggttttcatcaacacctctcattgcatagccactggtaccaaagcgtcctttctctacagcagtgattcccgtttcataacgcactaaatcacgagcatcctgcacttgttgacgttttagttgttttgcacttttaattgtttcgccgacctttttttgttgtatatcttggtcatctaaatctgatacaactttaatctcacctaactccgtgatagttgaattagtttgagcctgagaggggggggaagtaagccgtaaacggacaataccattgtggctgcgatagagatttttattttatgaggtgcatgaatttcaaacatatttccgccttgcactaaaaattaagtattttgatgaccttcaaccaaatgaacgaagcttactaaatcttcattacttacttggaaagcctgaccaaaaccttttacaaataaaccttgaatcggtttaaaactaaataaataaaaatccttataagtactaatttcatcaattaatgcaccatggcgttctctaagaacagcaatacttgctttccattcttcggtttcacgttcaatcacacgagatgtagcatcaaaagataaacgacggcgagcaaaaatctcacgacttttactttcgtcttcaataagcattaaggaaactttaggtacttcctgtaaattacgtgcgtgacgggcaatagttgaaataaaaacctgatattctccattagaaatggcgaatggggcatagctcacattaggtgtaccatcttgtccaacggtggctaacataatggttttgcttagtgcctttaattcttgaatttctggacctaatcgattttgtaatacttcttgacggtttgttgctgtcattttgatttcctcgttaattaaataaattgcttaaatttttctacttggtgcgggaataactgacgttgttcatcacgaccaagatagaccttaaaaatggtttgtccgttgttagcaataaaggcaatgttgtaactttctttgcctctaaatggcaaactgacaaatgcgatttgggcaagattgccgagtttcacatgaccatgtagtgtgccttcatcatctttcatgttgaggttataataaccacgaccaaccatacctgtaggaaaacgatctttaatttcaaaaatcgaaccctctttttcaataatggttgtaaaagttccccatttgctaatttcagtcataatttccaccgctctttcagcagagaaaattcgcacaaattcctcaggtaatgcacaaagaatattgccttccggttgctgaaaatgttccgccatctcaagcgtgatagaaagagggttttgagcaatgtaatctgcgatttgctgttttaatgtgtgcatataagttttacttaaattagaaatttaatttcataattgataattattcttaattgtatttgaatttatctactttgaaaagaggggagaagtggagttgaatcgataattattataattttttaatttaacgttttttagatacttgaagtctaaaataacaaccttatattgtgaaaactgctacaagaattaaaaaattatgggaaagaaaaaacgttcagcaagctccagccgttggttaaatgagcattttaaagatccttttgtgcaaaaggcacataagcaaaaacttcgttcaagagcttattttaaattggatgaaattcagcaatcagatcgtttatttaaacatggtatgacggttgttgatcttggtgctgcaccgggaggttggtcgcaatatgctattagacaaattggagatctggggcgagtaattgcttgtgatattttggaaatggatccaatcgtcggtgttgattttttacagggcgatttccgtgatgaaaatgtattacaggctttattggagcgtgtcggtgagaaaaaagtagatgtggttatgtctgatatggcaccaaattttagcggtatgccagcggtagatattcctagagcaatgtatttagttgaacttgcccttgatatgtgtaaacaagttttagcaacaaatggatgttttgtcgttaaagtttttcaaggagaagggtttgatgactatttaaaggaaattcgatcattatttaacacagttaaagtacgtaaacctgaggcatcacgtggacgatcccgtgaggtatatatcgtagctatgggttatatgggatagaaataactggtctgttgtcttattaataaataatagccaattaatctgataactttaaatccaaatagatttatagtatcttatgaaaaatttttaattactgaaatatggagttcaaaccttgaacgatatggtgaaaaatatagtcctttggatcgtagtcgctgtcgtcatgatgacagcctatcagagttttagtggaaactcatcaaataacgcaattgattacaccacttttattagcgatgtagaaaataaccaagtttcagccactaaatttaatgaggtcggtgaaatttttgtaactaaaaaagatggttcaaaatatacgacagttcttcctacaccgttagaagatcgtaagttattagatgatctgattaaatcaaaggtgaaaattgatggtgctttgcctgagcaacggggatttttatcgcaaattttaatttcttggtttccaatgatcttattaattggcgtttggttcttttttatgcgtcaaatgcaaggcggtggcggcaaagcaatgagttttggtaaaagtcgtgccaaaatgctaacgaaagaacaaattaaaactacttttgccgatgttgcaggctgtgatgaggctaaagaagaagtcggtgaaatcgttgatttcttacgtgatccaagcaaattccaaaagttaggtggtaaaattccaaaaggaattttaatggttggacctcccggtacaggtaaaaccttattagcaaaagctatcgccggtgaagcacaagtaccattttttacgatttcaggatctgatttcgtagaaatgtttgttggtgtaggtgcttcccgtgtccgtgatatgtttgaacaagcgaagaaaaatgcaccttgtttgatttttattgatgagattgatgcggtcggtcgtcaacgtggtgcaggtcttggaggagggcatgatgaacgtgaacaaaccttgaaccaaatgcttgttgagatggatggctttgaaggcaacgaaggtgtaatagtgattgcggcaacgaaccgccctgacgtacttgatcctgcgttgactcgtccaggacgatttgaccgtcaagtcgttgttggattgccggatgtacgtggtcgtgagcatattttaaaagttcatatgcgaaaagtgcctgtggcggatgatgttgatgcaatgacattagctcgtggtacaccgggatattcaggtgcggatttagctaatcttgtgaatgaagccgcactatttgccgcacgtactaataagaaattggttaccatgttagagtttgaaaaagcaaaagataaaattaacatgggaccagaacgccgttctatgattatgaccgataaagtgaaagagagtaccgcttatcacgaagcagggcatgcaatcgttggttacttagtacctgaacatgatcccgtacataaagtgactattattcctcgaggacgtgctttaggcgtaactttctttttaccggaaggggatcaagtcagtattagtcaaaagcaactagaaagtaagctttctacgttatatgcgggtcgtttagctgaggagcttatttacggtgaagaaaatatttcaaccggtgcttccaatgacattaaagtggcaaccaacattgctcgtaatatggtaactcaatggggtttttcagataaattgggaccgattttatattcagaagatgaaggcgaagtgtttctaggtcggtcaatggcgaaagctaaacatatgtctgatgaaaccgcacatacgatagatgaagaagtaagatcaatagtgaatcgtaattatcaaagagcaagacaaattctgattgataatatggatattttgcatgcaatgaaagatgctttagtaaaatatgaaaccattgaagaagatcaaattaggcaattaatgaatagagaaccggttgttgctcctgcaggttggactaataatgagtaaaatttatttgtagttttggcaacgtttagtaaaatgttccgactatgtcgtaggttctgattttttaataagggaaaggggttgaaagtcggtaatgtaacagaagtaaccccaaacaattattctttattttgggtagagtatgactttgggattttgttacgagacggcggaagaacagttaagaatattgaaaaaaacataataataggggcgatctactatagcccctatttttattgcaatttagataaagtttattttttatcgttactgagttttttattgaaaaataaatgtgattaaaaaatataaagactgagagtatagttatgaaaaaaatttttttaaaagaattacaaatgatttctttagatattttggattattttcatcatatatgtgaagcacataatatacagtattcactgggggggggaactttgattggtgcaattaggcatcaaggttttattccttgggacgatgatattgatgtatatatgctgtggagtgaataccaaaaatttgtctcagtttggaataaattatcacataatttctataaaatatctcctattgaaacttttgatggggatgttgtgggggaaatggctaaaatttatgatgagagaacttatttatcagaaaaacatagggcaagtcatatatttatagatatttttattttagattatgtgcctagtgatttaggtattttgtataaatctatgaagaagcatcgtagattaacacttaggtttaagtctttaaggaaacgtttttatcgagctaaagataagagtggttgtaaaaaaatatttggtaaattatcacaaatttattatgaaaaaatgcaagctaatctcagtcgattaagagaaacgtacaatgaaaaaaacagtgataatatcggtctttttttatctgactatgcttgctggaaaaaatcttatatgcctaaagaatattttcggtcgtttaaaaaagttaagtttgagaataaatatttttatgtaacggaatattatcatcagcacttaacagattattacggtgattatatgacattaccgccggaagatgaaagatctcctaagcatggaatagaagtatattggaaagagtgaggttacaaaattttatggcttatttttttatctaaattaacagcaaacaataaaacaatagataacttagagaaacaaaatgttgtaagttagattaattgaaggactggattttgtatgttaaatagacccagtccttttagtttgatacaaataatatttgtaataaatttctgtaatttttattttttaaagataatgtagatctgaaataacatgtgtaatgctattaaaaggttagtggggtgatacattttttagttaattgaaaaagtatcaccttcgtccattagattttagcccgatttttaggtatagccagtaaaattggtcatgtttcctattattaaaatttcattgaaatactcatcttaacattacgtccaacacctgaaactttttcacttagataagggttgtacttgcgattaaagatattgtctatgcttagagaaagcttcattccgtgtattttcttaggttcccatatggcaaatagatgatgtaatgagtagccactggatttaggaagtgaccaataccccgcatccggatcattatcaataggtgatctatcttgtcgacggaaaaactcaccttgccaaccaattgatatattccatttgggtaggtttgtacctaatgtcattattgccttacgaggagggatctctgctatccaatctttgcttctagattaactaaaggatgatctgatatgtaagcccagtctagagagacactttcgtcagtcagtttgcgatataccagtttccttttccaagcaatatcttctccccatttctttatgtcggatatacttggtgagggtaaattatcacgcatagcggcaaacggtgtccaaccggagttattggagcgtacagctgaaagcgtaaatttttgcttatctgaaggataaaaattgacttttaataaatagctcttattgtcattttcagagtataagaaacgagatccgtcagggcgttttatgttttgactattacgaacggtcgtgtaaaataagccctccagattttttgcttgattgcgtagaaaaattgcaccgctccaaatattctgtttatcattcgtatggtaactatatttagcaaatccacctatattttgattttcattgagaaaatcgctcggatttttagttataaattttaaggtttcaccaaatccgctattcccatattttgtagaaaagcttcctttatcaacctccacccgacgcagtaattccggttctataaatacagatccttgacgatatctttcaaagtttttttgtatcccgtctaattcaatacggacatcttcactatcaccaaatccccaatattgatattttgacctcccggtctaggtgaacctgacatattgacaccaggcaaaacattaactaaggctgcggcattgtcagcttgctgtcggtcaatattttttgttaatagtgttgaacgtccgatatcatactgttcattttgaactaagatgacaggaagagcgtcgtattgttgagcgattaatttgcttgtataaaacgtagatgaaagcaatatagtgatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgtatgaaggggggggaatttaacaaatttattgcacatgactatcgtaattaatgtaaataattgggaatataactaattatcattttaatgtaaagatttttatccgagagaataaaaaagaatatgaattgcataaacattcaatatagagttcaaaggtaagctactttgggcgtttttcagtgttttattcattatttttgtatttattctcaaaaatttttttatttttgttcattccaatattccgctataattgaccgcacttttaacttgattgcgtagcagagcaaatgaaattacaagcaaacaataaaactttggatcttactttacctaaaatcatgggaattttaaattttacccctgattcattttctgatagcggacaattcttttctttagataaagccttatttcaggctgaaaaaatgctgaaagctggtgcttcaattattgatattggtggtgaatccactcgtcctaatgcggcagaagtaagtttggagcaagaattggatcgtgttgtgcctttagttgaagctgtaagaaaacgttttgattgttggatttcagtagatacctctaaagctgaagtaatgttggaaagtgctaaagtcggtatggatataatcaatgatattcgtgcattacaagagcctaatgccttagagacagcggtaaaattagggttaccgacttgtattatgcatatgcaagggcaacctcgtacaatgcaacaaaatccccaatataataatgtagtgcaggaagtattggaatttttacaaaatcacaccgcactttgtttacaagcgggcatgaaaaaagaaaatattatttgggatcccggtttaggttttggtaaaactgtgcaacagaattataaattattacagcaagttgcccgattttgtcagcaggatattcctgttttagtggggttatcacgtaagtctatgattggtgcggtgttggataaacctgtaggccagagagtaataggtagtgcgacaggtgcattacttgcggcaatgaacggtgcaaaaattttgcgtgtacatgatgttgatgaaacattagaggcattgaaaatttggcaagcaacagaacaggcttagttttaaagagttgttctacaataagttgatttcacagagtgaaggataattttgcttctcttgcgttgatgaataatcaaggaacgaaaaatggcggaacgtaaatattttggaactgatggtgtgcgtggcaaagtaggaagttatcctattactcccgattttgtgcttaaattaggatgggcagcaggtaaagtgctagctacacaaggaactggtaaagtcctaattggtaaagatacacgtatttccggatatatgttggaatctgcattagaagccggattggcggctgcaggactatctgccgcatttaccggaccaatgccaacaccggcaattgcttatttaacacgtacttttcgttcggaggcgggaattgttatttctgcttcacataatcctttttatgacaatggaattaagtttttttctgcacaaggtacaaaattacctgatgatgtggaagaagcaatagaggctatgttggaacagcctatggattgtgttgaatcagctaaattggggcgtgcaagccgtattaatgatgcggcaggtcgttatattgagttttgtaaaagtacttttccggcacatttaagtttagataagtataaaatcgtggtggactgtgcaaatggtgcaacttaccatattgcaccgaatgtcatgcgtgaacttggtgcagaagttattgaaattggtacgcaacccgatggtatgaatatcaatgaaaactgcggtgcaacagatatcaaagcattacaaaataaagtattggaaacaaaagctgatatcggtttagcctatgatggcgatggtgatcgcttaattatggttgatcattttggtaataaagttgatggcgatcagatcttgtttattattgctcgtgaggcgttacgttcaggtaacttaaaaggtggcgtggtgggcacgttaatgagcaatatgagcttagagctcgctttaaagcaattaggaattccatttgttcgtgcaaatgtaggtgaccgctatgtgttagaaaaaatgcaagaatataattggattttaggtggtgaaaattcaggtcatattattattgcggataaaaatactaccggagacggtgtgatcgcttccttggcggtattagctgcaatggtgcaacataaattgtctttaaacgaattagcaagtgcggtgaaattatttccacaagtgttaattaatgtacgttttgcaggtggtgcaaatccattggaaagtgatgcagtaaaagcagttgcaacagaggtcgaaaaacaacttgcaggcaagggcagaattttattacgcaaatccggaacggagccattaattagagtgatggtggaatgtgaggatgctgaactggcacagctcagtgcagaaaaaattgctgaggcagttagatctaattaggtgtaataggataatgaaaatatttgtaatgcgacatggcgaagcagaagtgatggctaattcggataaagaacgccgtttaacctctcgaggtcggttgcaagttagcgaacgaggttattggttaaaaacggttattcctgattttgataaggttttggtaagtccttatagaagagcggtagaaagttttgaaaaaatcgatgaggcttatcatcatcaactaagttcaaaacaggaaatttgggaaggtattacaccttatggaagtagtcatttggtgatagattatttatccgtattggcaaataaaggtgttgataaggtcttgattgtttcacatttacctttagtgtgggatattgtcacagaattgtgttctaaacgtagccctatcagtttttatccctctacaattgttggtttacagtgggattgtgagcaaagtgcggtcattacggagataaaatatccggagtagtaatatgcaaaataacgatttcttatccgcctttattttttcaaccagcgttactctgccgacattgttaatgctgatgttgggtgttacgttacgagcaaaacgagtcattgatgatcgtttcagcggacaagcgactaaaattatttttaatattaccctgcctgttttattatttttaagtatttttaaaaatcctgtggattatagccaacaagtgcctcttttattggcaggagtggttggtacattaattttatttgttggtgctgagatttttgccgcaaaatttgttgtcgataaacgtgaaagaggcacttttgtgcaaagtgtttatcgaggtaataacggcattttaggtttagcattttgcattaatgcttatggggatttagcgttggcaccggcgtcaatttatgcggctgcattaacttttttatataatattttaggtgttattacgctaagtcgttctttatccgatggtaaagtcggtgtcaaaaaaattgttttcaatgttttaaaaaatccattaattattggtatcttactcggtattttggcaagttttaatcaggtggtttttccaaaagcaatcttgacgaccgctgattatcttgcgagcatgaccttacctttagcattaatttgtaccggtgccagtattgatgtgaaaggattatttaagattaatgcggtatctttatgggcgagtatcggacgattactggtcgcacctatttttatggtagtgattggcaaagttttaggtatcaccggtatacatttaggtatcgtgttattgatgtcttcaacacctttagcaactgcggcttatgccatgatcagaggaatgggaggcaatgctgtaacagctgcgaatattattgggttgacaacttttggatctatgtttagttctgttacaagtctgttattactgaatcaaataggctggatttaaataattttttcgtttttatttgattttgttattattcggtaacgtttatatagtgaatctattttttggcaaaatataaccgcactttggacttatctataaaagtgcggtttaaatttataaatcaatgcaacaaatcattcaaacattttccgacaacggcgtattaagtaaaaatatcaacggtttttgtcctcgagttgaacaaacggaaatggcaaaagctgtagggcgggcaattagtcaaaaaagtactttagttgtggaagctggtacaggaacgggaaaaacatttgcgtatttagtcccggcgttattggcaaaaaagaaaacgattatttccacaggttcaaagaatttacaagatcaactttttagtcgagatctccccactataaaaaaagccttgaactatagcggtaaaattgccttattaaaaggacgagccaattatttatgtttggaacgcttggaacaagttattgctcaaggcgttttggggaatagagaagtgttggcggatttggcaagcgtacgtcgctggaataatgcaacaaaaacgggcgatttaactgaatgtgttgaacttgcggaagatagccctattttaccgcaactgaccagtacggcagaaagttgtttaggggcagagtgtcctcattatgcagattgttatattgcccttgcacgcaaaaaagcacttaatgctgatttagttgtagtcaaccatcatttattttttgccgatatagtcgtgaaagaaagtggttttggtgaattaattccgcaagctgaagtgattatttttgatgaagcacatcaacttcccgacattgcaagtcaatatttcggtcaaagcattacttctcgccaattttttgatttatgtaaagatattaatattgtttatcgaactgaaataaaagatatggcacagcttggtgtagcttccgacacgctgttaaaagcggtgcaagactttcgtttattgctgggtgaagggaatttaagaggcaattggcgtgaagttttacgccaaagtgcggtagaaaaatcgttcagtttgttacaagaaaaagtggattttacagcggaagttatcaaattagggttaggacgttcacaaacgttagacagtatttttgagcgtattattcagctgaaagcaatgcttcaacgcttacaagcaacaaatatcgtaggattttgttattggtatgaaaccatgggaaggcaattcggtttacatattacacctttaaccgttgccgataaatttggtgaacaaatgaaagctaaagaagtcgcttggatttttacctcggcaactttagaggtggcaggaacgtttgctcatttctgcaaacgcttaggtattgaaaaggcggaacagcaagttttacccagcccatttaattttaccgaacaagcactattttgtgtacctcgttatttacccgtcaccaatcatcgtaacacattaaatcaattggctgaaatgttattgccggtgattgaaagtaataatggatgttgttttgtcctttgtacttcttatttgatgatgaaaggattagctgagtattttcgtgaacatagtcaattaagtgttctgcttcaaggggaaacttctaaaggaaaactgttagagcaattcattaaagaagatcattctgttttggtggcaacgtcgagtttttgggagggagttgatgtgcgtggaaaagctttatctttagtgattattgataagttaccttttactgcaccggatgaacctttacttaaagcaagaattgaagattgtcgtttacaaggtggagaccctttcaatgatattcaaattccggaagcggtcattgccctgaaacaaggtgttggtcgtttaattcgagatgttactgatcgaggtgcggtgattatttgtgatagtcggttggtttttcgaccttatggtgaattatttttacatagcttgcctaacgcaaaacgtacccgagatttaaacaaggtggtacaatttttggctcaaattaaaaaggagaaataacagaatgatgacaactttattagcacttgatacatcaacagaagcctgttcagtcgcacttttatacaaaggagaagtcacctattttgatgagttggcacaacgcactcatgctaaacgcattttaccaatgatcgatgagattttggtgcagtccggtattcaactaaatcaattagatgccttggtatttgggcgtggaccaggaagttttaccggtgtacgtgttggtgcggggattgtgcaaggcttagcttttggggcggatttgcctgtgattcctatttctaatttaaccgcaatggcacaacaggcttatgagcaatatggagcggaacaagttttgtgtgcaattgatgccagaatgaacgaagtttattttagtcaattacaggcagaaaaagtgcggttggaaaatactgattttgttcaatggcaagagttagtcaacgaacaagtttgttcgccacagcaggccttagctcaattaaaagatatccagattgaagattggacaatggtcggtaccggttgggaatatgctgaattcaccgtagcgggattgagtgagaagacgcaaattgatttaccatctgcccgttatatgctttctctggctttgccttcttatcatcaaaaacactggataagtgcggtagaagttgagcctgtttatttgcgtaatgaagtaacttggaagaaacttccaggacgtgaataattcatgatgtgtttatttttctattgctcgtgtacttgctgaattttattttgaagaaaatcttgatttataggagaagattgaaagatgttttattgcattgaggtttttgctaagagaaataaatctgctcaaaataaaaaattgaagtataatgcacccgatttttcacagaaaaatagtaaaaatgatagaaatatcagttaattaaagaggataaataccatgcaaaaaccttggtttcaaaattaccctgagggctcaccgctggaactggacacttcaaaatatgaaagtttgttagacatgtttgataaagctattcgtgagcatcctgatcgtccggcttatgtaaatatggggcaggttttaactttccgtaaattagaagaacgtagtcgagcttttgctgcttatttacaaaatgaactaaaattaaagcgaggtgagcgtgttgctttaatgatgccgaatttattgcaatatcccattgcgttatttggaactttgcgtgcaggtttggttgtggtcaatgttaatccgctttatacaccgagagaactggagcatcaattacaggatagcggtgcaacagcaattgttgtggtatcaaattttgcgtcaactttagaaaaagtcgtttttaatacgaatatcaagcacgtcatcctcactagaatgggggatcaactctcttttggtaaacgtactgtggtcaattttgtagtgaaatatattaagaaattggtgccaaaatataagttaccgagtgcggtaacatttcgtgaagttttggctgtcggtaaaaatcgtcaatatgtacgtccacaagtggaacgcactgacttagcttttttacaatatacaggcggcacaacaggtgtggcaaaaggtgcaatgttgacacatggcaatattattacaaatatttttcaagcggcttggattgcctcaccctttgtaggcgatcataaaaaacagcgtaaagccattatagctttaccgctttatcatatatttgcattaacagcaaactgtttactttttattgaattaggtattaccgcagttttaattactaatcctcgtgatattgacggtttcattaaagaattaaaaaaacatcgttttgtagggataactggggtgaatactttatttaatgccttgctgaataacgaaaactttaaagaggttgatttttccgcattgaagttgtctgtgggaggcggtatggctatccaacaatctgtagcgactcgttggcatgaattgactggttgcaatattattgaaggctatggaatgacagaatgttcgcctttaattgcagcatgcccaatcaatgtagttaaacataatggaactattggtgttccagtaccgaatacagatattaaaattgtcaaagatgacggttctttagctgaacttgatgaacctggagaactttgggttaaaggtgagcaggtaatgcaagggtattggcaacgtccagaggcaacggaagaagtgttaaaagacggttggctggcaacgggtgatatcgttattatggataaaacttatagtttacgcatagtagatcgtaaaaaagacattattattgtatctggttttaatgtttatccgaatgagattgaagatgttgtaatgcttaatcctaaagtagcggaagttgttgctattggtattccggatgaagtttcaggtgaaaaaatcaaaatttttgttgtgaaaaaagatgatagtttaactcgtgatgaaatacgccagcattgtcgtcaatatcttacagggtacaaaattccgaaatatattgaatttcgtgatgaattaccgaaaagtaatgtaggtaaaattttgcgtcgagtattacgtgatgaagagctggcaaaacatgcgtaaaaataaatatcaagtgggcgattaaacgcccactttttgtgtatcgttttacccacaatgatgtagccatgagaaaggttattgaataatagataattagcaagtatgtccgttttaataaaagaaatccaaaattcaccgcagtttcaattgattactacaaatgatcgtttatatgagatttgccaacaggcacaacaaaaaacggtgattgctttggatactgagtttgttcgcaccaaaagtttttatcccaaactaggattgattcaactttatgacggtgagcaagtgagcttaatagatccttttgagttgagtgatttttctccttttattcaacttttagccaatcaaaaggtcacaaaagtattgcacgcttgcagtgaggatctggaagtttttcaacattattttcagcagttgccaacgccaatgttagatactcaaattatggcggcatttttgcaacatggcaattccattggtttagctacattgctaaaacattatttcaagctggaaatagataaagggatttctcgcactaattggcttgctcgccctttgtctgacgtacaattgcactatgctgctgccgatgtatggtatttattgccattatgtcaacgtatgcaacaaaaattagctcaaacctcttggcaaagtgcggtgcaaaatgattgtgaaaatttgttgaaaaaatatactcagataaaagatagtgacaatgcttatttttctatatccggagcgtggaaattaaactctcaggaattaatgcgtttaaagctgttagcaaaatggagacaagaagaagcgataaagcgtaatcttgcattaaattttgttgttcgtgcagagcatttgattttattagcacaacataatccaaaatatacttcacagctgttatccattggtttatctccgctggaagtgcgtattcatggtaaaaaaatattacaactcttagagaaagcaaacaaagcaccggcgtatgactatccaccaccaattttgcgagtcactgatgatcatcgttatcgtgtagcaattaaattgttacaagcaacgttacgggaaatcactccggcagatttaccgactgaagttttgtcaactaagcgtatgttagatcagctgataaagtggcattggattaaacaagacaatcctcatgatttacctgatttgctttgcggatggcgtagggagtttggattattgttattaaaggctttgcattaattagatgctttgttaaatttttgggaacgaactcaagaaatcaaagggtatacaaattgataccctctatatttttagacagggaagaatgttgatatcttccctatatgtcaatctttaatcaagatatttgattactttaattactttatttacccctgaaacatgacgagcgacttctgcagctgcatctgcttgagattgagttaaatttcccattaagaatacttcaccattttcagtaatcactttaatatccgctgatttaatatttgaattgacgaataacttagatttaatttgtgtagtgatccagccatctttactaatttgtccaatagtaattggttgtgcaaggcgtaactcattatatacttcgtcaacaagttccactcctctagctaaattagttgcctgtacttttaaactattattcggaacttgtccgattaataaaattcgggagctataagaaactacattaacacgcccttcagcttttatttgtgcatcttttttaatcgctgacaagactttttcttccagtgtttcatcatcaatttgagtacctactgttctcggatccgttgcaacttttaccgcaactgccgtaccggtagcaataccaatcacagtggctgttgcacaaccttgtaataaaagagctgaactcagcaatagccctaacgttttatttattttcatctgatttctccttgttgaaattttgcctagtttgggttgaaacatggctttttgtcaagaactatgaatgtgaaaataatgaataatcaataagctcacataatgtgttaataattagcagatgattttcaagaatacgactttccttaccggtcggtactgaaatttctaaatcatttgccgttaaaaatccttgtatatgaccgttattttcaccggttaaagcgataatttgtacatctttatttaatgcacattgcaatatatttagcatcgtttcttcattgccgaaaggagaaaaaataattaatagatcaccttgttgtgcaattgcgttaaattgtctttgatacaacatagtatgacaattttcggaaataatggcagaaccgaccgcactatccaaacttaatagaacggaaggaaagctagggcgttccaattcatatctattgagtaaatttgctactaaaaattgtgcattagcataggatctaccatgcccacagacaataattttattacctttcagcaggcaatttacaatatgttgagttgcctctacgatttttgttgcaagtaagctggaggaagaaatttgagtttgaatactttccgtataaatatctttaactttttctaacataatttttattcatcaagaaaattaggtatccattggatatcatttgttgttgctccaaaagcgaccagatcgaaacggcagtccgcatcttctaaactggaatcatattgtgctaaccataggttggctgcatcaagccatttttgctgctttttccaatctacactgtcaattgctgaaccgaaaatttgatttttacgctgacgaacctcaacaaaaacgatcgtttgccgatcttgcataatcaaatccaattcaccgcagttaaagcgttggttagctgcaataaaggttaaaccttgtctctctaaaaagaggcgagcctgatattcaaaactcgcaccttgttgacgtttggattgtatcattcttcgttaatcagatagatgctgtcatcttgctcgttaagcggatagatactgccattttgatattggaaccaagtcatatcacgttcaacattacagttagggccggcactgagttttcctgttaacccatcaatggtaaatccgggaatttgacggaattcattaaattgatttattaataaccaagcatcataacccatagcatataaatgcattaatgagtaatcattattggtcattttttcaatttttttatattgttccgattccctatctttgaagaacggaatatcactaaattgcagattattcagaaacaaacgatgttcaggaccactgttaggcgaattactacgtgaacttgcataaagttttagggtcggattaatattatccaacactgctttaatttcagctaattgtttgttattagcaataatatacacgccgtcagtactttcacttaaccccgattttaatgcaaaattaatatctgcggtttgattatagaatttaatattggcatcagtacccaatagttgttgccaacgtagagtaaatgccgctgccgtgcgtcgccccagattattttgcggtactaaaacaagtggaatacgtactgcatcattccacattttacttgccgcactttcagcttcatcttcaggcgataatccataataacaaaggtgttcaattgcccgtgcattaggcgtagagttcaacgctaatacatttaaatcttgtaccaaatacggattattgactataacatcaacattttgtttgagtaatggtccgacaagagtgttaattccctgtttttttgcttgattaataatttgttctatagacattttcattgagtcaaatacgtgaacttgaacattgtaattgactttggcatcatcaaacccgtttttgattgtttcaccgataagtcgtgtattgccgcttaaagggagtattagaccgacttgcgttaaagtagtttgttgaaaattggcaagcccttgtaattctgtaggtaataaatgtgctgccgtatgtgttggataataatttttccaagtcagtaatgtttgaattaattgtgcaggttgattaaggttatcattgtatagttgagctaatgttaaccaaccgctcaatgtaatatttccttccgcatcagtattatttagtacttcactatctgtattgcgtagcaatgcccaagtgcggtcattattttgttgttttcgttgaatatcacttaaaaaattatccatttgaattcgagcttttatcgctgaaatattatcatgacgattttctgcaatacgagaaacaatctcataataacgtgatttttgtgaaggactaagtaatgtcaagtgaattaaagataattgatattctgccgtttcatttttgcctttaacagcagaaatatgagcttcaatcagggatttatctagtttttgttcatcatttaaatctatcaattcagcaagatatgcttccgcttgcgggattttattttctgttactaaaactcgagcagctaaaagtttataggtttgtaaatcttgttgattttgtgtttgttcaattttccgaatgtaaaaatcagaacttgcattggcatcattttttaagcttgccgtaaagctactgcctaataaattgacacagcctgctaaaaaaaacataactaaaatcgggagaaagcatttttttaagcgtaaaccttgcattaaaatagataacataaattgctccttgagtatgtgcaatgtaaaatgcacggtgatcttacttatctcaccaattaaaagcaaataaaagaagtgaaaaatgaataattcgacaggaactctatacgttgttgcaacgccaatcggtaatttacaagatattactcaacgtgctttagatgtatttaccaaagttgatttgatcgctgcggaagatacacgtcatagcggtttattactgaatcactacggcattaaaagaaatttttttgcgttacatgatcataatgaacaacaaaaagcagatgtactgattgagaaattacaacaagggttaaatatagcacttatttctgatgctggtacacctttaatcagtgatccggggtttcacgtggtgcgtaaatgtcaccaagcaaatatccgagtggtcccattacctggagcttgtgcggcaataaccgcattatgtgcatcaggcatcgcttccgatcgtttctgcttcgagggatttttacctgccaagagtaaggcaagacgagataaattggcaaacttagcaaatgaagaccgcactttgattttttatgagtcaacgcatcgtattttggattgcttgactgatattgaacttgaattgggagccgatcgctatgtagtgcttgcacgtgaaatcaccaagacttgggaaacaattcgaggagatcaagttggaaagttgcatcaatggctacaagaagatcttaatcgaacgaaaggagaaatggtgctaattgttgagggcaaatcaaaaagagaagatgaaacattttcccctcaagcgattaaaacattacaattggttagccaagaattacctttaaagaaagcagcatctattgttgctgaaatttatggctataagaaaaatgcactttaccaatttggtcttattcaaggttactaatataatgaggctataatctcaggtttaatttgggtataatcgccaaactttttaggtctgatttttaaggacaaatatgagtcaatttttttatgttcattcagaaaatccacaatccagactgattaatcaggcagtggagattttacgtcaaggcggcgtaattgtttatccgaccgattccggttatgcactaggttgtatgattggagataagcatgcaatggatcgtattgtgaaaattcgccaactacccgaagggcataattttaccttagtttgtagcgacctgtctgagttatcaacttattcaatagtgaataattcggtatatcgtttgattaaaaataatacaccgggtcgttatacttttattctaagtgcaacaaaagaattaccccgtcgtttaatgacatcaaaacgtaaaaccatcggtattcgtgttccggataatcaaattgcgttagatctattaaaatccttaggcgaaccaattttatcctgctctttaatgttgcccggagaagaatatacaacacaatctgatccggaggaaattcgagatcgccttgagcaccaagtagatttaatcattcatggcggatatttaagtcagcaaccgacaacagtagtggatctgacagaagataacccggttattttacgagaaggaagcggtgatattcgcccttttatataaattaactttattcattcccattatcatagacgcttgtgaaagcgacagtaaggaaaataaatgaaagtaaataagcaaaaatcccgtccaactaaaccgcactttgcaaagcaggttaccaacgagtctatgcgagataatacgaagcgatttgcaaacaaagaaacagtatctgaacgtaaaagtgcggtaaaaaacactcaaatttctccaatatcaacaaaatcaactcatgctatcaatcagcaaaaagtcgaaggggaaagactacagaaagtgttggctagagcaggacaagggtcacgtcggacaattgaagcaatgattagtgccaatcgtattagtattgacggaaaaatggcgactttaggtgatcgtgttgatatacattccggcgtaaaaatcagaattgatggacatattgtcaatttaacgcaagcacaaaaagaagtatgtcgagttttactctattacaaaccggaaggagaactttgcactcgacatgatccagaaggaagagcaacggtttttgatcgtttaccccgtttaaacggatctcgttggattgcggttggtcgtttggatattaatacatccggactacttttatttacgactgatggtgagttagctaatcgtttaatgcatccacgacacgaagttgaacgcgagtatgccgtgcgtgtttttggggaagtagatgatgcaatgattgctcgtttacgtaaaggcgttcaattagaagatgggcctgctaactttaccagtattaaagcaacaggcgggcaaggaatgaaccaatggttcgatgtcaccttgatagaggggcgaaaccgagaagttcgtcgattgtgggaatcacaaggcattcaagtaagtcgtttaattcgtattcgctacggtaatattaaattaacgaaatcgttaccacgtggcggttgggaagaaatggatctaaccaatattaattatttacggaaacttgttgggctaccgcctgaaacagatagcaaaattgatactaaaaaacctcgtcgtataaaaacgggacaaattcgtaaagctgttaaacgctatactgaattgaataaacgttataagaaataaaaaacttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcgtaaaggaaaacgagggcgtggagcaaccggtaaagtggctgtttttggcttgttaaaacgacagggaaaggtatttacggtggtggtagaaaataccaaaacagaaacgataatgcctgtaatcacaaggaaaatcaagcctgacagttgggtttataccgatacatatcgtagctatgatgctcttgatgtgagccaatttcaccacgaacgcatcaatcattcggagttgtttgcagtgaaagaaaatcacatcaacggtatagaaaacttttggagtcaagccaaacggatactccgaaaatataatggaattaaccaaaaaaactttcctttgttcttgaaggaatgtgaatttcggtttaactttggaacaccaaaagagcagttaaaaacattgcgaaaatggtgtggaatttagggctgatctaatacagccccaaaacttatttaaaagtgtgaattaactcacaaattttaaattacgtatttgcattatagaacatgattttttacattgcaccttataaaaagtgctataaaaaagtagccaacatattttgctttccgagtagtgcctcttttgaggcactttttttgtgtttgcataaaacaaaaaacctagcaattcaaaggttatcgctaggttagataaataaattagttaaacacgccgctgatgccgacacggaaacctactcggcctcgactatcagaagaaacaccgccggatatggcatattttccgtttgcggaagttctaccgaggtttaaagagaccgcactttcgctgctataatgagcggcaccggcggcataagaccattttcccgggacgaaagggacttctttgaaagccatcgcggcggcgataccggcttttgcgtctttgttgacttcttcaagacgttggttagtggcgtgtaattggcttccgttgacggcatcggttgattgatgagaaagcaaaccggcggcaacattttgaatacggcgttcattgcctttgctgcccacggaaacgacgccttttgcatcaacgccggcgtaattgccgttgactttaccgataccgcccgttgtttcgcctttttctacataagcagaagaatcaccgaggaagacggagttatcaacctcaacattaatattattaccgataacggtagttttagttcctttgtttacaatactactaccaattgagaatgagcgttctttatgtgtttgtacatcgttaccaatacttaaagagcgatctccatacacttttgcttgaggaccgatggcttgtgatctaagtccagcagcatgtgaatcccaacctattgctgtagataattcattgrtgctwytrgattkataaccaaawgcattactataaktgccagaagcygtagcaccttgtccaagagccgaagcaaatttcgcagttgctttygcytcatcacctactgctactgcaaaytttycagttsctttagaatctttacctatagaaaycgcctgtacacctgcatttgcttggwagcccattgctacggcataagmttgtgcctctgctgtcttaccaaccgcagttgctccttcatgtgctgcatttgcttcaaatcctacagcgacaccggactcagctactttggcattttttccaacggcaacggatttggtaccatccttatacattccttctgccttagcaccttcaccaatataaatatgcccattactaacattaatattattactatttgattgttgagcttgagccatagccgaatgagcagttaaaacaactacygcagttaaagataaataaaaaattttcacttaaaagaaatccttaaaaaaagagttaacatagaaaaatcataaaaaagctaaccgcactaagaggcgataatttatgacacgccttaaaaagaggtagtggttctaccaaagcgggcgaaattktaagcgggggggggtactgtcaataaaaaaatgaaaaaatgtgaaaaaagataaaaaaagtaaaaaatgaagataagaagcaaaaaagtgagaagtacaagtaaaaaaagtaaaaaaagcccgcactttttaacaaaaagtgcgggttggattgggaaattttgggttatgtagaaagcgagaagctatgatgatagttttggcttgtggcttataagtaacgtttaatccgttaagattttttttaccttttctttcatttggttgaactccaatgatattcattggagagtagttctgaaagttcattgaaagtgttttgcgtaaaaaagaggaatgctagtctcttaatttagcgggaggaattagtagaataatatccgcccatcgcactgtaaatcgcattttgactttgaattaaactgtatttcgcattcagaatggctaattgagaggcattttccatattagctgcattaagccattctattaattctgcgataccggcatcatagcggtttttgtaatattgcgtaatacgtttgttgtaacggtaagtctcttgtaaatttgcaacattttcttttgcttgggtataagagaaatagaggttgtctatttcatttagagctttggtgatgttttgttcaaaattcagttttgcattttcataagctgcctcagaaattttaacattccattttactgtattccaatttaagaaaggtaagtttatgcctaccgttcctgtcgcaatcggtatgttgaaagcattgtcaattttattaccgcttgatgataatcctgctcccagtgtgattgatggaaaccaacttttttgcattgctttcgcatttttaaatgcactattgaggcgatataaagagcctttaatatccggacgattggcaatggttgataatggaatatccaaatttacctccgcacttttgacttccaagatatttggtgttttgatgtttaaatcttcattcggttttaagttaagcaaattacgcaggatagtttcggcacgttttttttgtgtttgataattaatcagattattacgagccttaagaattgattgttgtgattgatctgtagttgcccgatctgctacaccttgcttgaatttattttgcataattcgactaatttttgagtaataattaatcgtttggtttgttactgcaatggcatcatttaaataggcaagttgatagtaagttgtgacaactgagttgatcagagagagttttgttgcttgtaaatcttgttgcgtagcggaatgtgtccattttgcagcagaggttttatcggctaaacgttgccataaatctagggtgtagctaatattgagtgaaccgccgtgagtaattttagagttgctccctgtgttaatatttttggcagctgaagaattaacgcctgtttggcgtgtgaaatttggtactaaatccgccgcaaccaaattggcattgtacagagccgtgtttactgcaatagtggctttggcaagatctttattattttccaaagcttgtttcaccagttggttaagcggctcgtcattatattgtgtccaccaattttcctgaatgttatattgttgagtcaatgcttcatattgctgaaaatcttgtaatgttgcatggtaactatcatcaatatttgcacaaccgattaatatattagacaccactattccaaacgtcattttagaaagttttaacataagttttccttatcttgtaagcagaaaagtgcggtctttttttccgcattttctgcaaattttatcatgtttttattcatgtgtcagagaggaaattgagtttaatttagatgcctttttgaaggtatatttactttaaaaaatggcttggtagttcctgatcacatacgattatgtcaaatttatctatcttatcaatataagctttttgaacttgatttatttttgatgaatcaattaccaaaatagcttgctcggttttctccattgctttttgttttgtttttacttcatcaaaattaaagcaagttacgcctttatttacatcaatccctgcagctgagatgaacgcttttgttgtgcaaattgcatccagttcattagttagctgaataggaattaaaaaagagttattctttgaataatttccaccgcacaaaatgacttcacaatgaggtttatcctgtagcaccataaaggtattaattgaacagcaaagtgcggtgaatttaatggcaggatcgatttgtgaggcgacgaaaggaattgttgaaccacagtcaaaaaaacacacatcgccgtctttaatgaaattagccgcaatgcgacccacttccattttttcggcaatatgctttgtttcttgctcaaaaatttggtagctgttatcggtgtttttttgtggatttttgacaatatagccaccaagtaaaacaactgagcctgtatctgaagccaaatcacggcgaattgtcatttccgatacatttaaaatagtggcagcatcacgcaagtgaattttatccatttgtttgagcaaaaagtctaatttttgaatgcgtgattgtattttcttatccataacaggctctattaattaaaacggttaataaatagcgttattgtctgttaaaccgttaataatagcaatccctgaacttgatccaattcttgtcgcaccatttttaatcatttcaattgcggttttagtatcacgcacaccacctgaagctttgacaccgatattttctccaaccacttgacgcattagtgcgatattttcaaccgttgcaccgcctttattgaaaccggttgatgttttaacaaatccgacccccagttcacgacaaattttacaagcagtgataatttcctctttggttaacaagcaagtttccaaaataactttaagtaaagcaccttcacaagcagctaaaaccgcttgaatgtctgcttttacggattcccactgatttgatttaatccaaccaatgttaatcaccatgtctatttccgttgcaccggcttttattgcttctttagcttcaaaagcttttacagtagataaattagcacctaatggaaatccaactactgtgcatattttaacatttgtattttgtaatttttgtcttgctagcggaatataacctgaattaatacaaacagaaaaaaaattatgttcaatcgcttcgttacaaagatccagtatatcctgttctgttttctccgcagttaatgctgtatggtcaatgaattgagcaatgtcataagattgcataaatatcctccttattttaggtttatgtgattattttcacttttttatatgatactgcaaaaaaaattaaaaactgtgactttaatcacttttttaacatttttaattttatatactgaataaaataaattttgtgagaattataacatttattacggagaaaaacattatggatattgcagtcattggctcaaatatggtggatttaattagctatattaatgatatgccgaaaatgggtgaaacgctagaagctcatgattttaaaatgggttgtggcggaaagggagcaaatcaagctattgcagccgctaaattaggtgcatcagtaatgatgatgactaaggttggtgatgatgtatttgcagataatactattaataatttcaagcaatatggtgtgaataccgattttgtcgaaaaagtggtgggtgtatcgagtggtgtagcccctatttttgttgatcgttcttcacaaaatcgcattttaattattaaaggtgcgaattcttacttgaaaccggcagatattgatcatgctgaagttcagttgaaaaactgcaagctgcttattttacaactggaaattcctttagaaacagtttattacgcaattgattttgccaataaacatcaaattccagtcattcttaatcctgctcctgcaagtaaggaattagacattagttatgcttgtaaatgtgatttctttatgccgaatgaaactgaattggaaattctaaccggtatgccagttgataatatggaacagattcaagcagcagctaatagcttatttttgaaaggattaaaaaatctgattgtgactttaggcgaaaaaggatcggtttggtttcatcgggatcaggtaacacatgtctcctcgcacaaagttaatgctattgatactagtggtgctggagatgctttcattggttgttttgcacatttttatatacaaactaatgatgtcaaacaagcaatgcaaatggcatcagcctattcagcctatagtgtaaccggacaaggtacgcaatcttcttatccggataaagcacaattcgaacaatttctacaatcgttaaaataaggagtatggtatgaaaaatattcaacaaatgcccgatggttatctcaataaaacacctattttccaatttattttgctttcttgtttattcccactttggggagcagcagccagcttaaatgatattttaatcactcagtttaaaagtgtatttacgctgagtgattttgccagtgctttagtacaaagtgcattttatggaggatattttttaattgcgatacctgcatcattggtgatcaaaaaaaccagctataaaattgctattttaattggcttaatgctatatatcggtggttgttcgctattctatccagcctcgcatatggcaacatacacaatgtttttagtggctattttctctattgcgattgggttaagtttcttggaaacctctgcgaatacttatagttcaatgattggacataaagatcatgcaacgttgagattaaatataagccagactttctatccagttggtgctatttcaggtattttattaggtaaatacctcatcttccaagaaggtgccagtcttgaagaacgaatggtaggaatgacaccggaacagttgcattcatttaaattatcaatgttagaacatacgttgtcaccatataaatacttaatcttcatattgattgcggtgacttttttattcgtaattacctcttttcctaaatgtaaagcagttacacaaacaggtaaatcagaagtgaaatttaccgatacgctaaaatatctagcaagtaatacaaaatttaaaaagggaattgttgctcaatttctctacgttggtatgcaagttgccgtatggtcatttactattcgtttggcactcaatttaagtgatatgaatgaacgtgaagcctcaaattttatgatttatagctttattggattctttattggcaaatttgtcgctaatttcttaatgactaaatttaagtcagatctcgttttactttggtattccattttaggtgtgatcactctagcttatacctcttttgttcatgatttttctgctgtttatgcggctattttcgccagtttgttgtttggtccttgctgggcaacaatctatgcctccgtactggatactgttaatcaagagcatagagaagtgggtggggctgttgtcgtcatgtctattatcggtgcagctgttgttcccgcaattcacggttatgtctcagatacattaggatctcttcaacttgcatttattgtacctttattctgttttgcttatgttggctattatttttatggaaaattaaaagaaaacaaggagaaatagtatgaaaagctacctttatttatctaaatcacaatttacagacaaagaacaacttatttttaaaaatgaaaagctaagtgcggtcgcatttcaatatcaatccggtattgaggcggtcaaactgatcaatagtaaaggttttctaattgttttacctttttatgggcaaatcatttgggacgttcaatttaacggacaaactctcacaatgaaaaatatgttcaacgaacctaagcggggaacaactattattgatacctacgggtgttttgctttccattcaggcttaattcgtaatggttgcccaagtccaaaagacgagcatcctttgcatggtgaaatgccttgtgccgtaatggataaggcttggttgattattgaagatgacaaattagggattggtggtgaagttgaatatgtgaaaggtttcggtgagcattattcagctagaccggaggtgatattatctgctgacagtacattatttaatatcaatatggcagtgacaaaccttgccagtgttgatatgccgttacagtatatgtgtcatatgaattattgctatgaacatggtgcaacattcagccaaaatatccctgaaagtgcggtgcaattacgccaaactattccggctcatgtgaaaccgacaccgcaatggctatcgtttaatgaggagattaagaaagggaattatacactgtcatcgttggaaaatgatgaaatgtataatccggagatagtgttttttatggataatttgcaacaatatcagtcacaacttgaatatcgtatgcgctccccgaaaggtcataattatttggtaaaattctcgtcagcacaattcaattatgcaacacgctggattttatataatgccgatcagcaagtgggtgcttttgtcttaccagcaacctgtcgtccggaaggatttttggcagctcaaaataatggctcattaattatgctaaaaccaaaagaaatgcggtattttagtgtcataacaggtattgaataacatatagcgaacaacataaatgcggttgacaaaagtttaacggtattgctaaatgcatatttagttaaaatatcctaatgaaatgtttaaaaaaattggcttttataaaaatctcttgtataatcgccggaccctgtgaatgtgtcggatttcccaccgcacattattttatcaagatcacactcgaaggggtggagattaagattgatggttgtgcttaagtttaataagcactgggtattaatattattctattggtaattaattaatgaaaacttttgtagcaaaaccggaaacggttaaacgtgactggtatgtagtggatgcgacaggtaaaactttaggtcgcttagcgactgagttagctcgtcgccttcgtggtaaacataaagctgagtatactccgcatgttgatacgggtgattatatcgttgttatcaatgcagaaaaagttgcagtaacaggtaataaagaaactgataaactttactactggcatactggctatgtaggtggtattaaacaagcgactttcaaagaaatgattgcacgccgtccggaagcagtgattgaaattgcagttaagggtatgttgccaaagggtccgttaggtcgagcaatgttccgtaaattaaaagtgtatgcaggttcagaacataaccatgcagcacaacaaccacaagttctagatatttaatcacgaggttaggaaaatggcagagaatcaaaactacggcacaggtcgccgcaaaagctcttcagctcgtgtatttatcaaaccgggcagtggtaaaattgttatcaaccaacgtgagttggacgtatatttcggtcgtgaaacatctcgtatgatcgtacgccaaccgttagaattggttgaattaactgataaattagatttatatgtcacagttaaaggtggtggtatttccggtcaagcgggtgcaatccgccatggtataactcgtgcattaattgagtatgatgaaacactacgtcctgcattacgtgcggctggttttgttactcgtgatgctcgccgtgttgaacgtaagaaaatcggcttacacaaagcacgtcgccgtccacaatactcaaaacgttaattttatatacaaaattgcaagccaaatggcttgcaattttttttcttattttgtcggtaaattatgatggaggcttatgcattgccttttcatttatggtagaatggaaagtctttattaattttcaagtcgtcggaggaaaagatgacaagcgctgcgaataaacgttcaataatgactctttttttagataaggttgatatttattgccatcaggttcgtattgttttagctgaaaaaggtgttgcttatgcaacagaaatagttgattctgaatctatatcagaagatttaatggaattaaatccctatggcacaattcctactttggttgatcgtgatttagttttattcaactctcgtatcattatggaatatttagatgagcgttttccgcaccctccattgatgccggtttatccggtttctcgtggtaaaagccgtttattaatgttacgtattgaacaagattggtatcctgtattagaaaaagcagaaaaaggttcagagagtgaaagagctattgcattgaaacaattaaaagaagaaatcttggcaatagcacctgtatttagccagtcactttattttatgagcgaagaattcagtttagttgattgctatattgcgccgttattatggagaatgcagcaacttggtgttgtatttacaggcacaggcagtaaagcgattaaatcttatatggagcgagtttttcaacgtgattcatttttacaatctgttggtgaaatgacacctaaaaatttaatggaggataaataggattaatatgtcgtataaatttttacctaaacgtccctatttattaagagcctattatgattggttgattgataacgacttaactccttatcttgttgtaaatgcaacttattcaggcgtaaaggttcctgttgagtatgtcaaagatggtcaaattgttttgaatttatctgcaaatgcgacaggtaatttattgctgaataatgaggcaattcagtttagtgctcgttttcagggggtatctagagatatttatattcctatgggagcggcattagctatttatgcacgagaaaatggcgatggagtcatgtttgaaccggaagcattttatgatgaattaaatattgacagtgttgatgaacagcctttaggttttgctgaagcagttgatcaaaagaaagtgaaaaagactgaaacaaaaacccagaaaggaacatcacatttgcgtattgtgaaataaactaaagcaattttttgaaccgcacttaaagtgcggtttttttatgaaaagtaatttaatcaattcttgtagttagaaatttgcattacgaggtgtgcgagggaatggaattacgtcacgaatattttgcacgcctgtaacataaacaattaaacgctcaaaacctaatccaaaacctgcatgtggaactgttccataacggcgtaaatcacgataccaccaataatcttcagcttttagtcccatttctgctatgcgtttgtcaagcacttctaaacgttcttcgcgttgagaaccgccgataatttcaccaattccgggagccagaacatccattgcagcgactgttttaccatcatcattcaaacgcatatagaaagcttttatatctttaggatagtttttaactacaaccggcgatttgaagtattcttcggctaaataacgctcatgctcagaagataaatcaatcccccaggatacaggaaattcaaacgctttaccggattttaatagaatatcaatcgcatcagtatagtctatttgagcaaagtctgaattgatgaaatcttttaagcgagtaatcacatttttatcaacatgcttttcaaagaattttaagtcatcttcacgttcatttaatactgcacggaaaacatatttcagcatatcttctgctaattttgcattgtcagctaaagttgcaaaagcaatctcaggttcaaccatccaaaattcagctaaatgacgcgttgtatttgaattttctgcacggaatgtcggaccaaaagtatagattttgcttaatgcacaagcataactttcaccatttaattgacccgataccgttagaaaagactctttaccaaaaaaatcttggctaaaatcaaccgcacctttatctgtgcgaggcagattttctaggtccaaagttgatacacggaacatctcaccggcaccttcagtatcagaagctgtgatcaagggggtcgctacccagtagaaaccttgttcatggaaaaaacgatgaatagcttgagctaagcaatgacgaacacgagctactgcaccaatgatattagtgcgtggacgcaagtgtgccacttcacgtaaatattcgatactatggcgttttgcagacattggataagtttcaggatcatcaacccaaccggaaacttcaattttgttggcttgtaattcaacagcttgtccttcagcaggagactcggcaatttttccagtaacaacaacggaacaaccggtagttaaacgtaaaatttccgtttcatagttttcaatatcattatttacaatagcttggataggatcaaagcaagaaccatcgtaaatagctaagaaagatagtcctgctttagaatcccggcgagtgcgaatccaaccacgtactgttacagtttcaccgaccgtgatttttccttttagaatattagccacagatgcaatttttgtcatataaacctcaaatcagtttttataattgtaaaacttagtcattttaccgtaactcattaaaattaccaaaatgtatcggaactttttgtttttgtgagatagcacacataatttatataagtcccttgtttattaggaaaatttcttggtataaatgaacaattttatgaattaaaataatcaggtagaacaggtagaaaatatggcaaaagtgagaaaagaggataaattacctctgagaatgaagcagctaggcaaaatttatcgcttaattgaacaatttgaagaaatttcacgtattgatttatccaagttatctcaactggctcctgcaactatcacctccttaactagagaacttatagaaaaaaaattggtgattgaaagagcggtacaaaatacggaaaatcgtggtcgtccggcagttggattatgtgtctcaccattttactggcaatctctttgtgcaacactgacatacgatcattttgatattttgctatgtgagctggatggcacaacaatagcccaagaagtttatcctcttgatctttctgatttatcttcattagaacaaatgttgccttgctattttgaagattttttatcaaaagttgggactaaattgagtcgtccgattactttttctattgcagtggcgggtaaactacaccatttgtctggttttctgcaacgtttgggggagatcgaattaaatgtggatctaacatctttatttgcaggctattttgatataccgattattgtaacggaatattttgaaacttggttattagcggaaagcacattaggaagcgtaataggatatgatgatgtgattttcttgcaaattgatgaagtcattaatttgagtgttttatcaaaaggggttattctacagagtgatcataaaacttgtatgaatattgaccaaatcattgttcctcgcctgtatccaatgcaagataagatcaatcaacatttatttgagcttgagcgatatcaaatacataatcaattgacttataaagcattttgtcaatttatagatctgtattatccaaataataatttaattaacacgacagaaaagatcaattttttatgtaaaaaagcacagcttcaagatcctttagcattagaaattttagctaacatagccgatattattgcatacatcttatccaatttagttaatcttttttcacctgagaaaattatgtttacctctcgtttgctatccgtcaaacatgttttccttaatcaaataaatcagcgtttagcacattatttgcataattcaaaaatatgtgaagtaatgacgagccagtatgaatggaatagtcatgaagttattgctgctgctattaaacaaaagatttatgatggtagtttgttagtttatatggaaaaatattaaaatttttttcacttagctgtcaaaaaggcgttagaaagcatttttgattgcttgactataaataaaggtttcagctgaaagtatcatagcaagacttttaacttttaagagttaaaggcttttggggtagcgaatttacgcccccagctcttttgaaatggattgtgctgtttgtttgagatgcatgagcaatatatctttgccgatttggtttaaacgtgcagttgatagagaaattgatacggagtagattacattgctattgatgtcaaatattgggcaagctaaacaagttacgcctgtttcattttcttcattatctacggcataccctaattctcgaatcttatttaactccagctccatagcactcagtgttacaattgtattagctgttaattttgtaatattcgtttgatttttctcccaataatcatctagaatgtgtcttttttcgtatgccataaaaatttttcccatagctgaacaataaagttctaaacgctgaccaatatacgctcgtgtacgcatcatacctgttgttggttcaagtttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagatgctcaagaacatcctgttggtatagtttggtctgctaaattatatgaggtgcaaaaatacttaagcttaactaaccatggttatacgccattgattgttgttatgaacaaagccaagttcgatgctctgtctccggcattgcaaacagcattagtcgaagctgcacaagaagcaggtgcttatcaacgccagcttaaccttagaaatgaaaaaagcattattgaaaaaatgcaaaaagcgggcgttgaaattattgagcgtgttgataccggaccgtttagggctgccattgaaaacgaagtacgcaaggcattcattgagaaaaatggtgatgatttagttaaaaaaattgatgcattagcaaaataagtatattcaatgataagaaacagaatttttattaaattgaccgcacttttacttattccttattcggaaggaggagcttatgttggcaaatggagacgttccaatccttcagctacagcatatcgtcaaacgattcggtaatcaggtagcggtaaatgatgttagccttaatattcaccggggagaaattgttgcattgctcggtgagaatggtgcgggcaaatccactttaattaaaattctggcaggtctctattctcgtgatgaaggtgaaatttattttcatcaacaaaaaatccaatcggtacaatctcttaccaataaaaataaacaacctattgcttttattcatcaagatttagggctggttgaatggatgacgattgctgaaaatatggcatttgtaatgggatttcctcgccgtttcggcttgattgattggaaaaaaattaatcaacaagcacaagaagcattggattttgttggtattcacctttctgctcaaactcgagtttttgacttaagtcgtacagaaaaagcgttattgaccattgctcgtgcgattgctgtcaatgctgagattttagtgttggatgaaccaactgcctctctacctgcaagtgatgttgaacatttattcaaggtgcttaatcgcctacgtaaacagggcgttggtatgatttatgtcactcaccgattggatgaggtcattaggctttctgatcgcattttagtcatgcgtgatggttattctgtggcagaaggttcgactaaagattatgatgtgaaagctctagtgaaggctattgttggtgaagaaacaagagaaaaacaacgtgaaccattgcctaaaaacacaccagaagtggtacggcttaacgaagttgttgttggtgataccggtcctgtttcctttagtttacatcagggcgaaatgattgcattagcaggattgcgaggtgcgggacaagaagagataggacgattattatttggactacgtaagttggaaagtggagacattagtttaaatgaatgtgcttatcatgccgagtcgccatgtgaggcaatttataaaggtgtagcacttgttgccggagaccgtatccgagaaggtcttgtcatgtcaatgacaaccatggaaaatctctttatcaatcctatcttaagcggtcattttccattaaaaaattatgcaagcaaaaaagaaaggtctgaatgttggtatcaattccagctctttgatattcggccgaaaaatttatttattgaggtcagttcgctttcaggaggtaatcaacagaaaattgtgcttgcacgttggatgcagctcaatacacctgtgctgattttagaagatccaactgcgggtgtagacgttggtgcacgagcagaaatttatgacttattaaatcaagccttgaaaaaaggtgttgcaattattgtgatttcaaacgattttgaagaaattgcacatctttgtaatcgagccttggtattcaaccgaggcgatatcgtgggtgaattattcaacgaacaagtcacatttgcgaatttgctggcactcgcttcggacgcatctgctaccataaattaattttcgtgtttttagaccgcacttaaacaataggagagcatcatggctcaaacaaatattaaatcaaccgctttagaacagcctgtatctattgcacgtgatgggttttgggcgtgggtttctcaaatgatcactcgatatgggttactctgcttatgttttttacttatcatacttttctctatgacaacagattcttttgcctctatgctaaccttacatgcgattttagaaagtaaatcaaaaattgcactattggcactcgcagcgacgacgaccatgattgtaggcaaaattgacttaaatgtaggttttggtattgttctttggcatattttagttattacactacaagtgcaattcggtttttcatggcaaatggcgactatcacagtactcattgtggcagcaatttatggcttacttaatgggattttagttgcacttgctgacattgatagcttcgttgctacattgggaacgggaacggtattgtatgcaattgctttatggcattcaggcggtcgccaaattgtcggtgatttacctgatgcttttattgctattaacagtactgagatcttaggtattcctatctcggctttttatgtgttaatcgttgctattgtcatgtggctggtgactgaacacaccccaacaggacgttgtatgtatgctgtaggaggaaatcctaccgccgcttatttgaatggtatttcgattaagaaatatacgattgtgccatttattgtatctagtttaatcacagggtttaccggagttctcatcgcagcacaacagggtgttgggcaagcaagtgttgggatggattatcttttacccgcactagtaggtgctttcttaggtagtaccacaattaaaccaggacggattaatgtttggggaaccgttgttggaattgctattctcgctattggtatttccggtattcaacaattcggcggtgctttttgggtcgagccattatttaatggtgcaactttattattatctatcactatcgcaggttatgcacaacgtaaacgtttattaggtcaaaaagcagtacacaagaaagcagcaacaaaataatttgttgtgttaattacccactaaaaggagaaaatttatgaaacagttttttcattgtagtttaagtgtagtggcttctgtagtcgcactctcttttgccggcaacactatggcaaatgatccatttgtcgctgaagcaaaacaacaagttgctacagctgctgctcaaaaaacaacttgggatggaccaacaacaggtccaaaagtacaacaaggaaaaaatattattttcattgcttctgatatgaaaaatggcggtgtattaggtgtaattgatggtatgaaagaggcaacgagtatagctggctggaaattagatattcttgatggagcaggtgcggtcaataatcaactttctgctttaaaccaagcgattgcccgtaaacctgatgccattgtcattgggggttggaatccaaatgtagcaaaaattccacttagcaaggcaactaaaaatggaatcacattggttgcatggcatgctacaccggaaccgggaccaattaataaatataatattttctataatgtcacctctgattctgaccaaattgctaaactctcagctcaacttgctgtagcaaactcagatggaaaagcaaaagtggttattcttaccgattcactatatgaaattgcgttacgtaaagcgaatgtgatgaaagaaattattgagcaatgtaaagaatgtcaggtactagagtttattgatacgccgcttgcagatacctcaagtcgtatgccgagcctaacttttagtttattacaaaaatatggtgataacttacaatacacacttgctattaacgatctctattttgatttcatgacaccgtccttacgttctgcaaacaaaggagaaatgccatacaacatttctgcaggagatggttcagttactgcctatcaacgtattcggactaataatcatcagtttgctaccgtaccagaacccctgaatttacatggttggcaattagtggatgaacttaatcgtgcttttgctggagaaaaaccctctggttatgtcactcctgctcacctagtgattaaagacaacgtggcatttgatggtgggaataagaacctttatgatccacaaaatggttataaagaagcctataaggcgatttggaacgtgaagtaatcaactattgtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctggtcaaccactacaggatcaatataataaacctcggggatatcttgcttattaatttgtttaattgcatgttcaattgcgacagcaacttgttttttcggtaattgatcaattgtattttgcattttgccttgtttaacgtattcaatagcgagaggaataccatcatagccagttataagcactttgcctgctaatcctgcattttcaaccgcagtaactgcacctattgccatattatcatttgcggcaaaaataccttgaatgttagggttggcagttaagatgttagtggttacatttaaagcctgttctgtttcccagttcgcagattgtgaagcaacaattttgatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcttcgatgcaacaagagttgctggataagcattacttacgtaaacatggtaagaatgcttattacggacagtaaatatgacataagtgctaaagtaaattgctttagcactgagttttagatgttattaagaatagcgtctaagacagaagcaattcccgctttatcatggtgtagagtgatcaggtttgcttgttgtttaatttcgtcctctgcattacccattgcgacacccagtccaactaatttaagcatagaaatatcattatggttatccccaaaagccacaacaaattgagggtcaatgtgccatgtgtttagtaactccaataatcttgagccttttgtatttccgctattggcaatatcaacacgatcaacccatgaccactcacaactaaacccaattgaagataaatgattaaccgcagtttgcatcaacgcacgatcaggatggctaattacaaatttccatatcgtttcctgatcatttaataacacattaaaatcaggaacatggcgtagtttgggatgtacttggggaggacaacgctgtacccattcggaaaatttacgcagatgctcattcattattgagtaattcattgtatcacgtgaatacattaataaatgtaaattgtatttttctgccagttgaatgacttgtcgggattgttctaaagagagaggatttgctgcaagtacggtatctgtttgtggttgatacatataggtaccgttacaacaaatcatgggagtagttaaattcagctcatggtaataaggataggcggcagtatgatgccttcccgtgactaaaatgacttttaagcctttatcaatacaacgttgaatcatgattttatttgacgttaaaatttgcccttggctatttaacaacgtgccatcaagatcaaacgcaatgacttggtatttcatcttttttcctattttgaatatcatctaattggtaaagtatagagctttttaagtccaaagggaatatattagtctttgcagggataggacaactgtataattctgtataggaaaattaaataaaactgaccgcacttttatgctcaccttataccgttacgatgcaattattttcaataagtacaatgatgaaatgtgttatgattaacacatttccagttttgatgtagagtaaattatgagtcaacatgaatctcacttcaatcattttgccttagccgaactgtatccttttgctacacaatttcctttgcaaaatataataggaaaaaaaggcatgcgaatcgtctatcgccattttgttcaagaacattgtgctgaacgtagattagtgattttggtcaatggacgtgcagaaaacttgttgaaatggacagagttggcttataacttttatcgacaaggctatgatgttttagtgtttgatcatcgtggacaaggctattctcagcgtttattaaaagagcatgacaaaggctatattgatgagtttcgtttttatgcggatgatcttactttgttagtggaaaaaattacttcgttgtatcactatcgtagccaacatattttggcacattctttaggcgctttaatcagcacttattatcttgccaatgataatcaccaaataaaaagtgcggtattttctgcaccattttatggtattccactgcagcattcattacgagatgaattcattattaatttaatgatgttgcttgggcagggctcacgctatgtatttggcaaaggtgagtataaacccgctgatttagataagaatgatttgagtctttgtcgtactagaatgaaatggatgaatcgtattaatcgtcgatacccacatattcatttaggcggaccaacttttcgttgggcatatgagtgtatgtatgccattaaaaaattacccgttgtcttaccccgaattgaaattccggtactagttttacaatcagaaagagaaaaaattgtggataaccaaaatctgcaaaaattgaccgcacttttgcctcaagctcaactagtgcagattgaacatagtaggcatgagattttatttgaacgtgatcgaattcgagacttagcactagcaaaaatcaatcagttttttactgaaaataacgccaaataaacacgcctaatgttgtaaaaaacaagcaaccgagaatatgtaacgatgtaatagttatgccttctagccatttatgttgaagcagattttcaataacttctgcactgaatgccgaaaatgttgttaaactacctaaaaatccagttacaaaaaataggcgatattcagttgaaaaagcagacgaatgccaaaacatagccagcattattcccataattaaacaaccgatataatttgcgattaatgtgccaaaggacaagaaagtaaacaacggattgagtaataatgtcaatccatgacgagacattgcaccaagagaagcaccacagctaattaagaataaatgtgtaaatagattcatatgtgtataataaacagaattaaatgatgttaaatagcgtgcagagatacctcgctaccgattcttgtgcgtttaacccaatgatttctaaattcgggcaagttgactttaaacgtggatcagcattactcatcacacaacctttaccaactttggttaacatttgtatatcattcataccatctccaaaagcaatacattgctgcattccataattccgctcggctaatacctgctctagtgcagtggcttttgatacattttgattcattatttctaaacaaacgggagttgaataagtaatgctgagtttgtctccatatgtggttttgagagatgtttcgatattgactaagtcttgcggttcccggccaaggaaaaacactttttctgtagtttttccatgatgttgagcaaaattcactactttatacataaaaccggaatcttgatggtatttacgcaactgaggaacttctgtattaataaaccaatcatccccttgatatgaattaacacatacatgtgtacgatcaaaaggtaagttcataatttcaaatgctattgtttcaggaatgtaattgcggactaaaagattgccttgcaaatcctgtgctcttgcaccgttagaagtaatcattactgcatttttgatcttaattttttttaagattggtagcaaatccgtatggttacgccctgttgctaagataatatctataccttgagatgcaagcttttgtagtgtctcgatagtgaaatcgccaatcatatgattggcattaagtaatgtaccgtctaaatcagagacgatggcacgaaaaggaacattttgcatagcctatctttatcctatactgaaatcacagaacagattatttaacccaagtgacgatttcatcaagggatttacgggattttggcttaatttcttttgctcggtagccgaaagttgccattaccgaaactccccattcgtctgaatctaatacacctgcgtcagttaaaatttgatttactttttcataattaaaaccttcaattggacaactgtctattccaattaatgcagcaccagttaacatatttgctaaggcaatataggtttgtttacttgcccagtcaaataaagtgcggtcattctcaagcgttttcatatgttctgcttgaaagagatgatatttttctttggtagcttgtatttgttcgccggataacccacgtcttttcatggattgtactaaaaattctgaatcatagcgtgcattctttttcgctaagataacaactaaatgactggcatcgtcaatttgagttgccattccccagctgacaggttttaattttgcccgtagttccggattttggattactaaaaaatgccaaggttcagagccgacagaacttggcgaaaggcgagcaaattccaaaacataagagaaatcttcatcgctgatttttttatttggatcatagtaacgtgtggatgcacgacgattaaaactatccagcacgtgttcttttgaaatagtcgtcataataaatgtcctttaaatatttagcgaattgccatttggaataaaaccacttcagcttgacaaccaaaaacaatacgcatttttaaacgaaaaccatttgaaatgtcggtaatttgactctcaatatttgcagggtcattttcaatatcacgagctttctgaataaaataatcacgagcgttcaacgcttgtttttccgtatcgtattccgcttcaaaaacaacttctcttgcggaattatccagcattgaatcgcctttgatacggcacatattgtgtgcttctgccactttttgttgcaatgttttatcactcatgattatttccttatgcttaataaattaacctaccacactcggtaataaacctgcttgaactaggaatggaataatcacaataaatacaccaataactaatacagcgataagggaggctgagccaccttttactcgatacggtaagtgtgggtaaattttacgtaatttccataccattgcaataggtaaaacgattgcatagaatgcaaacatttgtcctgcatatcctaaagctaggataaacccttgaggatagaatagtgcaaaagcaagtggcggtaagaaagtgagcagaccaactgaaacacgattagctgaaatatttactcgttttagcagatcttcaatcgcttcgaacaaacctaaggcaacacctaagaatgaagtaattaatgcaaatgcagagaatagacgaactgcaccgccaataatttcacttcctgtaattgtaattgttgctgtcaccaatccatttaaggttggatcttgttgtaagattgccaaaaattctgtttggcttagtacgccatgagtggctaattgccatagaatataagcaacaagtggaataaaggttccgactaagatagaaacgcgtaatgcctttacatcgccatcaaggtatttattcaggctaggaatagaaccgtgaaagccgaaagaggtaaagaaaatagggcttgctgagatgattaaggcattatcaattggaagtgcgagtaagttttctaaagagactttaggcagtaataagaaaagcactacaacaaagaaagcaattttactgaaaaaaatgatgcgattaatcttatctacgctatttgtgcctgaaataatgaaaataccgaaaagtacagtaaataatacacctgcaatccgagatgtggtttgttcatcgtgaatggtgggcaacagtcctgcaagtaaagagcttccgccggaaatgtaagctgaaactaaagcgtaaagaaaaattaacagtacaacagtagaaagaatacgtccgaaagatccgtaatatttttcagccaaagtcccaattccagcatcactgtctacagtctgatatagctcaacgaaaagtagggcggcaaaagagagtaatagccaaagcccgattaataaagtaagtgtaaagccaaaaccgattccggctgaggttaatggcatagcgagcatgccaccgccaattgttgttcccgctacaataagcgtacttccaagcgttttgttcatatttttctcccatgatgaaaataaaagtgcggttattgtaacttatatttttttaaaagtgtaattttatttttacaaaatgtaatattatatttacacatttgttttaggaaagagaattggcttaggatcttgatagaacaattgtactttttgtccaatttctaaggattgcattgtttgaatggtgatttgttgtacatcagatagagtaacttggtactgataatattgccctaaaaattgactttgagttattgtaccatgcccctgtaaagttggtatgacctgaatttgatgtgggcgaaccagccaatgtaactccgtattttgtaatagtggagattgatcagcaagtgtgagtaagttgtcgataggctgtataccaaagattgaatgtaattgattttgttgatcaatatagcaatcaatatagttatatttccctaaaaattcagccacaaatttactgttaggttggtaatagagttgatctgttgctccgacttgaataatttttccatctttcatcaatgcaatattatcggcaaaagcaaatgcttcttctttgctgtgagttacaaagattgctgaaatgctttgttgtttcactatttgtttaatttcatcaatcatttgatagcgaacttggctatcaatatttgaaaaaggctcatcaagcaatagtagttttggcttgcatgctaaggctcgagcaatagcgacacgctgttgttgacctcctgacagttggtgagggtaacgatcttccagtccatctagatgaactaagttaagcatattttgcgaaatttgctttttttccatcgcactttttttatccaaaccaaactgaatattttctttgactgttaaatgaggaaaaagagcataatcctgaaaaataaaacctatgttgcgttgttctacagggacaggtgttaaatcttgtccatttaagtagatttttccttgtgtaataggctgtaatccggcgatggcttttaatagtgtcgtttttccgcaaccacttgctcccaataagcataaaatttcattttttttcaattctagatcgagttgatgtaagacaatttgttgtttgtattgacaactaagtgattgaattttaagactattcattatcgatccttttctgaatgtaaaatgagtgaacgagtgagccaaataacagggattaaaccaacgagaattaatgttaatgcaggcaaagcggcatgttctaattgttcatcggaagtaaaagaaaaaacataagttgctagggtatcaaaattaaaaggtcgcaataacaatgaggcgttaagttctttcatactttcaataaacaccattaaaagtgcggttaaaattcctttagaaagtaatgggaagtgtactttttttaacatttttatgccattagtacctaagctttgacttgccatatctaatgtaggaggaattttttgtaatgatgtttcaatacttccgagagccatagcggaaaagcgaatgacataagcggaaactaaagcaaacattgatcctgaaaaaattaatcctacaggagataaatttaactgagccagtatagcgttaatttgatgatccgcaaatgtgtaaggaattaaaataccgatagctaaaactgtaccgggaatagcgtagcttaaactcgcaaagcgtaaggtgaattgtgcactacgttgtatgtgatttgaatgtagatttaagcgttggtaaaaatgtaaaagcagagcgaaaattacacaaacaattgaggcggtaatagaaactgacaaactgttataagcatattgtgaaaatttatagagttgtgattgttcaaaataatgaattgcccaataactcaattgtgcaacaggaataaagaaagcacaagtgactaatccccagcaataagtttgtactaaaaagccttttattccttttaatggcttaagtgcggtctttttttcataccctcgttgataggttttttgtttgtaacggctataattttccagcaataagagactaaaaataagcaataaaatgaacattgagatttgagcagccgagccgagatctcccagtcctaaccaagtgtcataaactgcggttgttaatgttggcactgcaaaataagatacagtgccgaaatcgcccaaggtttccatcgcaactaaagcacaaccaatagcaattgcagggcgagttaaagggaaaataattttttgtaataacttgcgtggtgagcttccaagtaatttagcactttgaattaaattttcgctttgttccaataaggctaaacgtactaataggaaaatataagggaaaagaactaaagcaagaacaatgcaagctccccataatgttctaatggaaataaaccaataatcttgtgcacttgaccatgaaaaagtttgccgtaaaaatacttgtacagcaccggcatagtctaataaatccgtataaagataagcaactaaatagccgggcatagcgagaggtaaacacaatagccattgtaagattttttgtccggtaaattgatattgagaaataaaccaagcacaaggcaaagcgaaaactaaactaaaagaaacagttccaataacgagaagcaaagagtttagcagataatcaaacagaacagtttgccaaagatgttgaatgttttgccaattgaggctccaagattgataaaaaatagcaatgatcggtgttacaaaaaacaacgtaataaaaagtgcggttaaaaaccaaataattttatttaatcttgaggaaaataaaaacattcgaaaactaattataaagtaatgtaaagtttaatggggcaattatagcataaactcaaagtcagtgagatcattaaatgcccagtttagaaacaggataaacaaagaaaaaagcctagtggatttagcatactaggcttgttcttttagcaaatattaaagatcgaatttgacttcatcaataagttttaatgctttatcgtagttttccgctattttatttagtggtagcggatctttcttaaatgttccccaagattttactttttcagacggttcaacaccagcttttactggatattcatgattaagctctgcgtataaatgctgtgctttatcaccacttaaatattcagcaagtttaattgcattttctttatttggtgcatattttgcaatagcgataccgctaatattaacgtgagtaccttttgctttttggttagggaagttgatataaacagcctccgcccaagagcgttgtttttcatcgtctagcatttttccgaagtagtaactattgcctaaagaatagtcacatacaccttctttaatagctttcacttgatcacgatcgccaccttgtggtttttgtgccaagttgttttttagtccttctaaaaatgcttttgcttttgcttcaccatcatgtgcaatcatagaagcaacaagagaaacgttgtaagtgtgtttaccagaacgcacacaaacttttccttttaattcaggttttgctaagtcataataagtgaaatcagcaggtaatttacctacacgatctttagaagtgtaaatcgcacgagcacgagttgttagtccaaaccattgatcattagcatctctatattgtgctggaatatttttttctaaaatttcgctatggataggttgtgcaagacccgcattcacaatttccatcacacgtttaatatcaacagttaataatacgtctgctggacttaattcaccttcacgttttacacgttcaactaagcctttattatcaaaaagaacattaactttaatccctgtttctttttcaaactcttttaaaatcggttcaataagataaggttgacgataggaataaacattaacttcatttgcagctaaagcactggtggaaacggtcgctgctaaggctaaggttaatgtgctgagtgattttttcatgaaaactccttgtaagaataaatattaagtaaaggatacgaaagagctgtattaaatactttaatagattaaaagtcaataagaattattcttgattgtgtaagtaaaattttaagttttatgaccgcactttacacaaaagggaaaataacttgattattttcccttttaattcaatttggtaaagcggttattgccaatattttttctttgaggtttgacctattcccggattgaaactatttgttgggtcaagggctttgtagaatttgcgtaattccggttttgcttgatacaaatgcccaacattatgttccgccggatattccgcaccacgctgatctaataaatcaagcatttggtgttccaattctatacaattatgaccttttttaatgatatagtcttggtgaaaaacatggcacataaaatgaccgtaataaagtttgtgtataattttattttcaatttcagcaggtaatttttcaaaccattctttgtcattacgacgcaaagcaacatccaaagcaacgatatcttcaacatctttatcgtgaattgcacgataacgaattgcagccgaagcaacagcaaaacggtgtaacattgctgcttgagtttcttctgcattacattggaaataattacctttagagttatcggaaaaatactcttttaagtattcttgagcttcttgaacacctgtaccacctatttttacaataagatgatgttcatattggtcacggtattgccataaggatttcggtaaatgttccggcatcgcttttgataaaatttgcataaacttatcactgaaatcattgggtaaaaaactgacttttttggcgattcggtcaactttagctttcaaggcaaataatttaggtaagcggtgtgtgccaaattttttaataatccaaaaagtatctttaccgtatttggcggcaatgtcaaaagcatcacgatgaatatattcgccagagattggcaattgttggaaattagctaacatatgacgacgaatgtcgtttaacacatctgtttgatttgttccaatgtagaaaactgcggtatgtttttccatcggaaacgtatctaagcggactgcaaaaacagctaattttccggcactcccggaggtttcataatgtcggcttggatcagcgttaaatcttgctggagagttttcatcaatttggcgtacatgttcgcaataagaatgatcgtgtcctctgccacaatgttgttgaatatctttgcgttgataacgttggttttgtaaattttccaaaatttcttcaggatcattacctaagtcaatgcctaaatgatttttgagttccaattctccctgttcattaagttgagcataaagtgccatttctgtgtaagccggtcctctttgcaccaatgcaccgcctgaattattacatataccgccaataacagaagcaccaatacaggatgaaccgataacggaatgaggctcacgcccatgtgtttttaataaaatttccaattcatttaatgtcgaaccaggtaagcaaacggcttgttcggcattattgattagctgaataccgttcatatacattgtattgataatcacaatatcacgatcatagtcattaccgcttggtgttgatcctccggttaaaccggtatttgcggcttgatttataataattacatcagcctcaacacaggcttttaatacgttccaatattcaaccagattagtaggacgaacaacagcaatcgcatttccgttgccaaaacgatagccgctacgataactttcagttttgcttggatccgtaataataaatttattgcctacaatgtcggtgagcttggagataagttgttgagttgtcatcgtcataaaatgttccttgcttatttgaaaaaatcgacaacattataacaaatgaatgttgactagaaatgatgaaattctattcaattatacagtttttttgatgattaaaaagataattgagtttgagctaacaataaaagatgagttttgttgagaaatatgatacaaaagactccgaatttttatttactcttaattaggaaacgatatgtcgaatttacaaaatattattgagcgtgcatttgaacgtgtagcagaaattaccccgacaaatgctgaagcagaacttagagcagcggtagatgaagcgattgaaggattagataaaggtatttatcgtgttgcggagaaaaatgaacaaggcgaatggattgttaatcaatggttgaaaaaagcggttcttctttcttttcgtttaaatgacaatgttgtagttgatggtgcagaaacaaaatattatgacaaagtgccggtgaaatttgcagattatgatgtagaacgttttaaaactgaaggatttagagccgtaccgggagcggttgttcgtaaaggttctcatatttctaaaggtgttgttttaatgccgtcttttgtcaatattggtgcttatgtcggtgaagggacaatggtcgatacttgggcaacagtgggttcttgtgcacaaatcggtaaaaatgtgcatttatccggaggcgtagggattggcggagtattggagccattacaagcaaatccaacgattatcggcgataattgctttattggtgcacgttctgaaattgtggaaggtgtgattgttgaagaggggtgcgtaatttccatgggggtattcatcggtcaatcaaccaaaatttacgatcgtgaaaccggcgagattttctatggtcgtgttccggcgggttcagtcgttgtatcaggtagcttaccttccaagtgcggtaaatataatctttattgtgcagtaattgtaaaaaaagttgatgcgaagacgttaggcaaagtaggcattaacgaattattaagaactatcgaatagctaaaattcatgtggtttctattatctacctgcctcttaacataagaggcagattttttataaaacaatagttttattttgatacacaaaaattctgtcatgaagtgccaaatctaaagcctgcgttagtaccgctttttctacatcacgtcctgctttcatcattgcttccgcattataagtatgatcaacattaatgacattttgcataataattggtccctgatctaactcattattaataaaatgtgctgtcgcaccaataattttaacccccctttcataagcttgatgataaggttttgcaccgataaatgcgggtaaaaatgaatggtgaatattaatcactctattgggataacggctgacgaattcgggatttaaaacacgcatatatttagccaaaacaatataatctggagcatattcgtcaattttttcagctagtaatttatcatgttctactcgagttaatccttcatggcttacacaatgaaacggaatatcaaaacgctcgaccaacgaacacaaagtttcatgattcccaatcacagcggcaatttctacatctaatccgccataataggttttcattaaaatgtcgcctacgcaatgtgcctctttggtaactaaaattacaatacgttttctttttgcatcaactaaacggcaatttgtaccattcggtaaactatagtctaaatcggcaagtaaagtttgttgattaaaaataccttccaattcagtacgcataaaaaagtgtttagtttcaaaatcaacaaattcattattatgaataatattgagctggtgtttgtaacaaatattagtaattttagcgattaaacctttatcatcaggacaatctgttaataggattttattttcaaccataataaatagtgatttattgtgttaagttaataaaaacttaagttagagatttatagcatgattaaatttcgaaatcagccaatgtttttcctgtatttaattcagcttgcagagataaaggcatacgcccctgacccgtccaagtttttactttaccattttgatctgtatattggtattttgctttgcgaggagctatttttttacgagggcgtttagtggtaaaggttggatcatcgactaaatcagtcaaggttaagccgtcttgtgctagcaatgctttatattttgcgatacgttccaaacgttcttgttcttttcgttgattttcttcaattagttgacgtcgttcatttgtaattaattgaaatttctccaatatactttctaactcttgcagagtgaattcttttgttgctacacgcaatgctcgaatactggttaatgtttttaataggtcagacatttttactccttaattttatattgataattcgctttcaaataataacgaaaaaatatttttaggtaaatcttaatttaaaaatagtctaaattttaattttatatattagtttaattattttacattaattatagattaatacttggaattttgattttcttattgtaatcttactcgctcctacatatgtagaggtgcggctgttataagtaattttttgagtggataacgatgaaaaaaatgaaaggaatagttgccgaaatcaattaaaagtcattttaattggttgggggcgtattcgaaagaaacgtcactgtcatagtatttatccactatggagcgctactggttaggttggtatgggttattttgatcaccttattttaattatatttaaaatatcaatctcagtggttctcccttaaattaggaagaacaacatggaacttgtaaattattccacatctatttattcggttattccaccgatattagctttgctattagccattgtaactcggaaagtcattttatctttaagcattggtattattaccggtgctttaatgttgaccaaagatacatccatattggatagtattccttatttgtggaatcatatctccgctttggtttatagtattgaagaaaacagctcaatcgcatttgcgtgggacacaataaatattatcctctttttagttttacttggtgttttgactgcacttttaactgtatccggtagtaaccaagcctttgctgaatgggctcagaaacgtattaaaggtcgtcgtggtgcaaaattaatggcggctgctttagtgttcgttacgtttattgatgattatttccatagtttagcggttggtgcaattgcccgtccggttacggataaattcaatgtatctcgagcaaaattagcttatattcttgattcaacagcagcacctatgtgcgttatgatgcctgtatccagttggggggcttatatcattaccttgatttcgggactattagcaacttatgccattaccgattactctccaatcggtgcatttatggcgatgagttcaatgaatttttatgcaattttctctattttattggtatttttcgtggcttatttttcatttgatattgggtcaatggcgagacatgaaagattggcattagagagaggggatacagaaagagaagttgaaatacaaacaaagataaaagggcatgtacgaaatcttgttttgccaatagtggtattgattgtagcaactgtggcaatgatgatgtataccggcggacaagcattaattgctgacggtaaagcctttagcgtgctgggtgcatttgaaaacacaacggtagggatttctctcgttgttggagggattgcctcagtggtgatggttactctctgtattttaactgatggtcagattagtttaaatgaatatataaaatcttggggattgggtgcaaaatcgatgtccggtgctattttaattctgtgctttgcatggacgattaattcggttgtgaaagatatgcaaacagggacatatttatccagccttgtatctggcaatcttcctattgcaacgttaccggcattacttttcatcctcggtgcagtgatggcattttccacaggaaccagctggggaacatttggaataatgctaccaattgccgcagaaattgcatcaaatgctgcccctgaattaatgttaccttgcttatctgcggtaatggctggtgcagtttgtggagatcattgttcccctgtatctgatacaacaattttgtcctctaccggagcgaaatgtaaccacatggatcacgtaacaacacaattaccttatgcgttaacattagctatggcaacaattgtaggctacttagttgtcggtttcacgttatccggattgttaggttttatcgcttgtggcgtaacattagctgttttaatgttaattttaagaaaacgctaatatcgttttaattttgtttttgaaccgcactcataagtgcggtttttattagagcggagtttaaaataagtgtagaatagacaaaagttatcgtttatttcttatttaggagtaggagcaaaacatggcaatcttagttaccggcggtgccggctatatcggttcgcatacggttgttgaattattgaatcatcgttttgaaattgttgttttagataatttatcaaattcctcggaagtttctttacagcgagtacaacaaattaccggaaaaaatatcactttttatcaaggcgacattttagatcgagaaatactacagcgtattttttcaacacataaaattgaagcggtgatccattttgccggattaaaagccgtgggagaaagcgtaaaaaaaccgttgcactattatcagaataatgtgaacggttcgattacgttactggaagaaatgctaaaagcaggcatatataacttagtttttagttcatcagcaactgtttatggagaccctgaaatcattccaattaccgaaacttgtaaagttggcggaacgactaatccctatggaacatctaaatttatggtagaacgtattttacaagacgcagtgagtgcaaatccgcacttgagtgttgtcatacttcgctattttaatcctgtcggtgcacatgaaagtggtttaattggagaagatcctaatggtattccgaataatttattgccttatatcagtcaagtagcagtaggaaaattaccacagctttcagttttcggtagtgattatgatacacacgatggtacaggtgtgcgtgattatattcatgtggtcgatcttgcaattgggcatctaaaagcactggagaaacaccaaaatgatcaaggctgtcatatttataatctaggcacgggaattggatattccgttttggatatggtaaaagccttcgaaaaagcaaatgatattcaaattccttataagctagttgaacgccgtccaggggatatagcaacgtgttattccaatcctcaaaaagcattagaaaaattaggttggaaaactgagcgagatttaacacaaatgatgaaagacacgtggaattggcaaaaaaataatcctaatggttataaatcgtaagtcgtaagtgagcgttttaacatacggataagacaattcagctatcaacatttcaataacaacagaacaacgttgagtgtttctgttgttattttaaacgatttagcaaaaaagataggcgacaaatcgcaaagaataaacttttttctaaaaaacattttctttacatttaaagttaggataaaatcgcccggataaattaataatacttgacaaataaaaatagaatagaaaaatgtctacagtctacagtctacagtctacagtctacagtctacagtctacagtctacagtctacagtctacagtctagtatattgcctaaaatcaaccttgcaaggtaaatttgtgaggttggayatgttcaaacaayatcttaaaaatcacctatttcaacctcaacctttcggcgaaartattattcgyctttttctrctgtgccttaaaaagcaargcrtcgcctatttattcatcaaactatctaaaaagcaaaaagtttaatcaatcaacaaccataaaaaagttaaaaaaaatcaaagaaataaacaattgaacaaccaattttaaaagattaaagagagtgaaactatgaacaaaatcttcaaaactaaatacgatgtaactaccggtcaaactaaagtggtgtctgaattggcgagtaatcgtcaattggcgagccgtgttgaggcgacggagagtaagccgaagtgcggtgtgtttttaggcatgtttaaggtgttgccgttggcgttggtggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatgtccgctattgctataggaactagtgcaacagctaacgctcaaaatagtgtagcgttcggaaatgaagctagcgtaagcatggaaaattcggtggcattagggaataaatcacatacaaaatatttctatcaaaatgataataacaaaaacactgccacgctcatcggaaacggcaaaaatgaggcgattgagttagccccttatgttccagagggttctagctataacttaaaaaccgataaagcggcgggtattgtgtccgtcggttggannnnnnnnnnnnnnnnnnnnnnnnnagaactgggcttaagacggattgtcggggtagcaccgggtgcgttggattctgacgtggcgacgattggacaattaagagccttagcctatgtaaaaaaagagggcgtggtaacttactataccaaagagggaaacaagatcattaagctgaccaaaggtgatgatggtaagttctataaagtcaacaccaaagacggcacgccttacaaggacttaggtgcggttgacgcaaaaaatgttttcgttggtccaaaaggggcgaatgaaaaaacaagagaagaaatgattcagcggaaaaaatactcgctcggaaatatgggcgaaagaatcaaatttgctaatattttagatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacaggctttgagaaagtccaatttgatgcagtagaagtagctgatccaaaaaagaaaacgggaaaaatagaaaatttcaaagaagccttgactgactctatcgctgcaattaatagaggttataaatttattgatgacnnnnnnnnnnnnnnnnnnaatgaaacacctttttatttaggttcaaccattgtaatcaaagcaggggatgttacaaagtcaggtacaacgacagagaactatctaggcaaaaacctaaaaacagaatttaaaaacgatagttcaaaagcgacattcaccatcggcttgaaagaagccccgagctttaaaaaagtcacgattgaagacaagattgaggataaagaagctaataaaaaacttgccgtcaacaaagagtatgtggataacaaactymaaaaygtytcgacsaatttacatttcttatcagtacaagggaakgataaagccgcagtcaactataataacgatggagcaaaagcaaattattctgttgctattggggtgaatgctcaagtagtagatcctactactagtggagtgcctcctaaaaaaacaaaaccgacagcaacagcaggtatagcgataggatataacgctaaatctgaagcagaaaatgcggttgctataggtagagatgtaagtattgacgtaccgaattcttttgttatggggtctaataatacagttacgcaaagctttaaagagacaaatggtgcggttgttgtgatcggtagtggaacaaaattagtagaatcaaaaagttctattgctataggtgcggtttatgtggaaagaggtgacaaaaaagatggtactgtaatagagaatgcagcttggacagcgtctatcgggaataaaaataaaattaaaaatggtacggatattgttgcactggggaataatattgaagtcaaagatgaaacaaatgaggaaaatccaaaaaataaaacaagaattgctaataatgatttaattctgattggtaatggagcgacagctgaaactgcaaaagaaagtgtgcttattggggcaaaatcaaaagctgaaacgggtgcaaaaagtgcggtgattatyggtcatagtgctaaagcmgargcaarygccgtcggtgcagtagcgattggrcaaggtgcaacagtaaaaaccgmcgccggcaactccattgcsttrgggcaagggtcagaagcgackgmaaaagaagaggctaaaaaagatgctactgtaagttttgacagtacaaatattaaatttaaatggacaggaggcgttagttccaatagtggtgataaaaaatccgttttaagcataggtaaggcaggtaatgagcgtatcattaaacacgtcgccgcaggtgcggtaacggaaacttcaaccgacgctatcaacggaagccaactttacgcygtcgcygatgaattttcwaaattagcggtgaatgtattrggtgcggaaaaagccgacggcgatacagcaggatttaaaaaatcgaattttgaagtagctaaatatcakggaagtacaamtgcwycaacacmaamrgaaatgacytttaaagacgcaattggtcaaaatacaayagcgattaatmaaggctttatttttggcgttggcgatcgwastrrtgaataaggaacgcattacttaggcgataaattaatcatcaaagcgggagcaatcgataaaccgacgacaatcacgacatcagaagatggctattcgccgaataatattaaaacgcactatgaaaaaaatagtaaaaatatattaatcggcataaaagataaaccgacgtttaaaaatgtgattattgaaaatggtattcctgaagatgaggaagagcttaagaaaggtaattatgataagcatgctgtcaacaaaaaatatttagacaaaagattagaaaaagtcgccgctaatttcacggttaagggggataattctaaagatggaaaaagttataccttagataaagagcataatgaattaaatattaatggagatagtgaaaatatcacaaccgcagttgataaggaccataaaaaagtcagtatcaacttaaaagatactttaacaggtatcacttcaattgctaataatgatacaaaaattgaattaaacaatggaactggtggaagtggaacaaaatctatcgttttcacagttggaaattcaagtaagaaagtaacattaactgaagataaattcagtggtgtgtctgaaattggaaaagatgatcaggctaaaattactttcaacagcaacggtcaaaaagaaatagactttaaagcagggagtacaacctataaatttactgacagcggattagatttagctagcaaatcaatcacaaatctagcaagtggattagataatgttgtaaataatggtaaaaaagacttagacgagctattaaaacttgttgatacaaatggacaaagtggtggatcatcaaatgatggcaaattaaataaagcaatcaatgcaggcgatttgcttcatgtcgctaatgaattaaaaaataaagggctgactttccaaggaaatggtgatgatactgacaaagttaccggaaaactgggcgaaaccttaaaaatagttggagaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatctatcgtcttcaaaactggaactagtggtaatgatgtaacactaaccggagataaattcagtggcgtttcagaaattagcagtaaagacagtaaatctaaattaacacttgrtgctgataaagcaactgtagaattagmwcatgrcaaatcaaaacttgaattaaaagatactgaagcaacaatcacagctggagrtaatgccggaagtattaaaattacaagtaatggwrryaagaaaattgagttaagycctgaaaayggagctaaattaacacttgcaaaagatagcactactaatagtggctctagcaatgttaaagctaccggtttatctcwtgttgggttaaatgaacaaaacgctttaatytttaaaaatggaagtagtaatagcaataccgctgttttaaaagtgggtaatgctgatttaacatttacacaaacaggaagtaatggaaatcaaaaagtccagatttcaggattatcaagcggattaactgatattggttcttctaccggtactagyggcaataatagtactcaaaaattagatgaattattaaaactaaaaccacaaycaagtggaacatcaaataatcaagacaaattaagcagagcagtaaatgtagaagatttacttgatattgctcaaggcttggtkgataaaggacttaaattccaaggaaatgacacttcaagcacaataacaacaaarctgggcggtactttaaaaatagttggagaaacagcaactkcaacatcrggaacaactgcaacaactcaaatkacmaccgcacctgataacattackgttaagaaaaaatcaggtagtgamgatactttagaaatagggttatctgatgctttaaaaggtattacttctattagtggtaaaaatggcagcaatggaagtgcggtwgcgaaaattgaatttacgaatggcggtactggtggcagtgcttcaaccagcccaacggtcaaaatcaccgctggcggtrgmacatttasctttggtgaaaatggcttggatttaggtagcaaaaaactcaccgcacttgctagcggtttgggattaacaaacggtgtcggtactggtggaagtactggaaacggaaacgaggaaattattgaaaatattctcaaaggaacccctgatggcactaatggttcccctaaaattgccaacaacgcygtsaaygtsaaagacctrtcccaagtcgccmaagcgattgtkmmwaaaggmytgacytttgcmggraatacaggtgaggctaaagcckcactyggcgataaaatcacgattaagggtgatgrarcktatttraccagcaaggcttcttcaaatggtagtaaagaaattgwgttttcwttracrgatagyacgaaaaayaaagtmgatattatcaatgtcggcactaccaacaacggcgayaattcctttgcgttgggtaaaaattcaaaactagagacgaaaaagaccgcacctagtggaattataccgaatgcaggaaaagatgaagtcaaatttagctggacaacagcaggggcttctaaaactacaaatcctgttgatatgaaagaagtcattagtgttggtaatacaaacgctgaacgcattattacscaygttgccgcaggtaawgtcgataccggytcaacygatgcgattaacggyggacaactaaaaagygtcattgatgtctttgctaatttagggataagtgtattgggtgckgagaaagccgaagctgacaaagacggytttaagaaaactmcatttacmgcattraaaratacwagcggasmaaaygrarcrrctaaagayacatttaaakmcgcaatcaatgcyaataytgmcaaaatcaacgagggcttgaaatttaaaggagatactaacaatggwagcaayrgygagcaacaactctacctcggytcraccttgacgattaagggagcggraaccaccgcacaaacatctactcaaggtgcgggtgcagccaaacatcaaaacattacyacwacsgcmaaarayggtggaatactkgaaatcgctttgaacacgaatttraargacattacmtctatygggaaagatgawaataatgttttaacgtttraaaatrgyacaagtggtggaaactcagtggaattaaaagtcggtggagcgwctttaacattcactmmawcwggaaatggtgacaargttaaaatytcrggtattgcagatggaagaagtgagaacgatgcggtaactgtcaaacaattaaccgcctcaaaattgcattatttatcggtaaaaggaccaaatggaactcaaaacggtgagaattacaacaatgacggtgcaaaagcccaaaattctattgctataggttctaaggcaagtgtaaaagacgacaaatcacacgatgccatcgctattggttataactcattggtagaaaatgccaaatggtcaatggcaattggtgccaatactcaagctaaatcaattcaatctttggcgttggggtatgagacaaaagtattagaaaatagcgatgcttcaatcgccatcggtgtatctgacacaaaaatagaaaatgctaaatgggcagtagcattaggaaacaaaataacaataaatggttccggtaataatgtagttgcaataggaagtaatattaatgtaggaagtggcaacgatgatttaatcgtaataggaaatagaggcgacagttcaccacaaataacaaacgccaaaaactccgtcattatcggcaaacaggcaatttccaaagccgaaagtgcggtggtactcggtaaaagtgcgactgttcaagcaagtgccacaggtgcggtggcgattggtgaaggtgcaacggtagctgaaaccgccggagattctgtagcgattggtaaaaactcaagagcagatgaaaaaatgtttgcaccggacggaatagacgctaatgttggtagtcagtcgttgaaaatcaattggaaagacgcaggtgcttcagctacagataaagattataaatccgtgttcagcataggagatgttgacaatgaaagagtaataacaaatgtagctgcaggatatgtaatagatgggtcaacagatgcagtaaacggcggacagttatatagtgtaatacacacatttggcaatttggcaagtgatgtacttggtgcagaagttaatactgatacggataaggaggcagatggaacacctaagtatggcttcaaaaaatcaacgtttgttgctgttcaatataaggatagaacaaaacaagcgaaagacacattcaaaggtgcaattgatgaaaccattaccgccatcaacaaaggccttaaatttgccggtaatactggtgaaaagcaacttcaactgggcgacaccttagcgattaaaggtaaagaagatagtgcaaacagctcccataaaaacatcagcacagaagcgaaagacggtgatattttagaaatcgccttgaattcagagttaaaaggtattaaatccattgaaaacggtgataatgcaaaaattgctttggataaagacgcaaaaaccattaaatttacctcaggggatacaccgacagaggttagtttaaaagctagtaccttgagcggtatcactgagattaataaggcaacggacaagggggcgttaaaactcactgagaacagtgcgaccttagaaagcacgaaagacaattcaaaacttgaattgaaagacaaaacggcgactttagaaagtgccaaagacggttcaaaagttgagttagcagatgacagtgcaaccttaagtgcgggtaaagrtrmcggaagtattaaagtyrkcaatggcacggagaasaaaatcgagttaagtccggaaaacggctcaactgttacgttgaaaaaagacacgacaaatggtaatactgtcaaagccagcggcttatctaccatcggtaaagatgatagtaacrccttagtgtttaaaaacggtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtgaaaatctcaaatgtggcggttggtaagatagaaagtagttcatcagaagctattacaggcggacaacttgccgatttagctactcatttaggggttaatgttgatagctcaggaaaaactgggtttacagcaccatcatttrawgytatmaawggcggtacaactcaaaaaacctttaaaggrgcgattgatsatttaatcaccgccgtgaatggtggcttgacctttaaaggcaatgatacttccccaacttcaaccacattacaattaggcggtactttagccattgatagctcaacggttggtagcggtgctaatggaacgactgaaaaagacatcactgtatcattagcaccaaatgataaagatgttaaagatgccggtacactcacgcttaaattaaataaagcgacagaagttaaagaaggcgatgaaaaagtcgttacttctaaggctgtagcaacaaaattgaaggactatacgacaacggcagatttagacaaaggctatctcaaagtcgatgggtctaatattgrtgaagatgamgaraccaaraaacaaggcagaaaaacattcggtggcaatgtcggtatnnnnnnnnnnnnnnnnnnnnnnnnnnnnnnnnnnactgaattagtacaggcggatgcggttattaagtatctaaaaggtacaggtcaaaaatccgttaaagtatccgataatccrgaaactraggctgaaggrgwckrttctattgcgattggcgataaagcrrtrgcaaaaaatgaargkgcaattgctatcggytatggtgctaatgctaaaaatagaaacgcactttctataggcagagatagtgaggtattgggcgagcatgctacggctattggtttccaaaataatgtattgggtaacgattccggtgcattcggtaaagataataagattagcggaacgcatgcttacgctgtgggtgcttataatgacatcaaaggcgaacayacttatgtcttgggttcaartrtyacgacaamtraagatataamaaatgctgttatyttaggtaatagatcaacaggtrtatctgatgccgtgtctgtgggtagtgctggcgatggcgaacaaagacgaattgtttatgtcgccgatccaaaaaatcaatacgatgcggtgaataaacaatatgttgatggacttggattaaaattcaaaggtaatgataatcaagagatacataaaaaattatcagacacattagaaatagttggtaagggtttaaataaagcccaaactgctaaatttaaaggcacaaatggaaatattgccgttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaagcggactattagaaaaacacaacggaaatgattctgaaagaaaaggtttagacgatttaataggagaaaattttgataaatcatcgattaaaactcatgcagtcaatgttggagatttagctaaaatttctaaggaaatagttgaaaaagggtataaatataacgctgatattctgtcaggtaatagcaatgataccagcataaaactaggctcaactatatctattgttaaatggacaaactcgccggcatcggggactggacaaccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacgacaacagctgtagtcaccattggcacgaaaaatgatttaaccaatatcacctcgatttcttctaaacctaaagctggaagtgcgggcggaaatggtgctggctcaactggagacgtgactaaacttaccttagatccaactgatggtgcgactttccaagtgggtagtcaaggtgcgaaagtgaatatnnnnnnnnnnnnnnnnnnnnnnnnnnnnnnnnnnnnnnnnnnnnnnnnnnnnncgaatgatccaaatgctgacaaaccatctattaccattaacgcaggttctgtaccagctactccaaacagtccagcacaacctgctgacccaagcttgcctgctgttgataacggaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgcgagcaggtgtggctcaagctgttgcacaagcgaacttaccgatcaatatattaccgggtaaaagtacgttaagtttggcgaccggtaactatatgggtacgcaagcctttgcggtaggttattccagagtatctgataatggtaaacttagcgtcaaattcagcttaggacatggcgataagaaaacttctgtgggtgcgggaattggttatagctggtaattctggacttttcatccatcaaaaaagggcgtttatacgcccttttttctattagtgtcgatattttttgtcaatctaaccgcacttttcgtaaatactaaattaatttaagcaatacctttatgtcgcagtagtgcatctaattgaggctcacgacctctaaagcgtttaaatagaatcataggttcttccgatcctccacgagttaaaatttcatctaaaaatgaacgacctgtttccgcattaaaaattccttcttcttcaaaacgggaataagcatcggcagataaaacttcagcccaaagatagctgtagtatccggcagaatatccgcctgcaaaaatatgactaaagctgtgaggtgttcttgcccaatccacacctttgatcaccgcaacgtcagatttaacctgttttaaggtcgctaggatttgatttggtttattagcttcaaaataatggtgtaaacggaagtcgaataaaccgaattctaattgacgtaaaacaaacattgccgcttggaagtttttcgcttttagtaactgctctaatttttcttttggtagtggcttgccggtttcataatgtcctgagatgaatgctaacgcctcttcttcccaacaccaattttctaaaaattggcttggcaattctactgcatcccaaggcacaccattaattccggcaacatcagcgacatcaatttttgtgagcatatgatgaataccatgtccaaattcatggaatagagtagtgacttcgtcatgggtgaataaagcgggtttgtcaccaatcggagcattaaaattacaagtcaggtatgcaacaggtttttgaattgaaccgtcagctttacgttttcgtccaatacaatcatccatccaagcaccgccacgtttattttctcgagcataaagatctaagtagaaacttcctctcacttcatttttttcatcaattaaatcaaagaagcgtacatctttgtgccaagtgtctacaccaaaacgctctactgctcgaatattgaaaattcgtttaattaattcaaatagacctgaaataacttgatcttccggaaaataagggcgaagttcctcatcattaattgagtataaatactgtttttgtttttcgctataaaagctaatatcccaaggttcaagtgcggtgatattgtaatttttttggcaaaattcttgtaattcggtcaattctttctcgccttgattttttgaacgttttgctaaactttccaagaaatcaataacttgttgtggagtgtccgccattttggtcgcaagggaaagctctgtataagtattaaagcctaacaaatgagcaagttctacacgcaaagtcaaaatttcttgcataacatctgtattatcccattttcctgcatttggtcccagttctgaagcacgagtagcaaaagctcgatacatttcttctcgtagttctcggttttcacaataggtcatgacgggtaaataactagggaattccaaggtaaaacgataaccatcaagccctttagattgtgcggattgttttgctgcttgtaatgcactttcaggcaagccaattagatcttgttcattttcgacgactttatcccatcccattgtcgcatcaaggacattattactaaatttagcgtttagttcagataaacgagcaacgatttcaccgtatctttgctgtttatcttctgataaggcaatacccgataattcaaaatcacgcaacgcattttctatcgctttcttttgtgcaaccgtatattgggtaaattccggactattttttagttgtacataggcattatataaccctttatgttgccctaaccaagtactatattctgaaatcagcggtaaacaagcttgataagcggcacgcaattcaggactgtttttcaccgcatttaaatgagaaacaggcgaccaagcacgaccaagtttttcctctttatcgtttaggggttgaataaaattctcccatgtaaagtgcggttgttttaacacttgttctaccgtttcacgattttgttggatcaattgctcaatcgccggttgaatatgttcaggtttgatttttgaaaattgtggaagttctgaatgagttaatagtggattagacataagtgttcctcaaaatagacagttattttatataaaaaagtggtaagtagattgggatttattctggaaaatcaaggttgaggtctaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaattttatatgaagcaatttttcgtatttgtatggtgaagcgaaagctcgatattattaagggaaaataaatgactaacacacaaaaatattaccgcattgctttattgttcaacgccaataaggtgtatgatcgagaggtggtggctggtattggacagtatattcaagcatcgcaatgcacatggaatatttttgtggaagatgattttgtttaccataaagaaaccattgaacgactgtctattgatggtattattgcagactttgacgatcctgaaaccgtttccttgttgaaaaatattgatgttcccactattgcggtaggtgggtcttatcagaattttgctgattatccgcacttcccttatgtcgctactgataattacgctttagtcgaaaccgctttttcccatttaaaacataaaggaattagtcaatttgccttctatggtttgccgactcaagacactcggcattgggcaaatgagcggaaaaatgcttttgtagatttaatggaaaaatatgcttatcaattttctgtatatttaggtgataaaactgattcaggcagttggcaagtggcacaatcggaattatgccaatggctacaaacattgccggcacataccggcattattgcagtaacggatgcaagggcaaggcatttattacaagcctgcgaatatttgaaaatagccgttcctgagaaactttgtgtgattggtattgataacgaagaattgatccaatatttatctcgcatttctctatcgtctgttgctcaaggtaccaaacaaattggttatcaagcagcgaaaatgttgcatagtctgttaagtggacataaagtgagattacaaccaattttaattcctcccttaaaagtagaagaacgggcttctacggattaccgttctttgcgtgatccttttgtgattcaagcaatgcattatattcgccaacgagcctgtcatggtattaaaacagagcaagtattggattatttaaaaatttcccgttctaacttggaacaacgtttcaaattggaattaaacaaaaccgttcatcaaattattcatgaagaaaaacttaaccgagccgtgtatttacttcgctttaccgatatttctatgccagaaattgctgaaatctgcggttatccttctttgcaatatttttatgcagtaatgaagaaagcctatgggataaccccaaaggcttttcgtcgataaattactaaagcactaatgatttagttactgattgagtaaaatcagggttgaaaatctaaaaaaaatgagaataattgaaaactgtttttattttattagtaagctgtatgaaaatcgtttatttaagttttggttttatttttctcgcattaggtattcttggcattattatgccgggattaccgggttttccatttttactcttgactattttttgttttagtcgaagttcggagcgtgtgcataattggtttttgcagacagaaatataccaaaagcatgttctaccttttaacgaaaatagggggatgcgtaagaaaacaaaatacaatatcttaatttttgcgactattatgatggcaattgctttttactttacacccagtgcggttggcaaatcgatcattcttgttgccttagtcattaaatattggtatttcttatttaaaatcaaaaatttaaaaacgtaactgatcttgtttacgtgtttttgtataatgtctcaaataatttaaataagtaacaaaaatgcctttttatttccttcgtgtttatctgtttttattgctaaaaagtgcggtgctttttagtatgctttttttatctgcttgtaatgaaaaacaagaaaatattaagactgaagtttttcaacataaacagtctgagcaagttcagttgcaagaaatagaaaaaaagcaattaacacgaggtatttatgctgagttggtcgtagatcctttgttgctgaaagaagaaggacaggcagagattttgcgtgatattttcgaaggattaacaggctacaatacgcagggtaagattattccggcggttgcagaatattggcaaacggaagacaacaaaaactggatttttgtgttgcgtaaagatgcaaaatggtctaacggcgtcaaggtcatcgcacaagattttgtggatagttggcatagactggctttatctgataatccattgaagatttattttcgtctaatgaatgtcagtaatgcggaatcagttttaaataaaatgttaccggtagataaattgggggtttttgcatcaaatgaacgcttattacatattcaacttgataaaccgacaccacaattaccggccatgttgacccatgctgttttattacctcaatatcaatcaacagataatgaatttataacgaatggtgcttatcaaattgctgaacgacaagaaaaacaaattgctttagcaaaaaatccttattatcgagaatcggaaaatgtttattttgatcgagttatttatcgagaaatttcccaaaatcaatcgattaactctttagatttcgttctgaatgcaaaatcatcgcaggaaaacttaatttatttgccccaattatgtgtttatttttatgagtttaatttttctcacccccatttgaaaaaaagtgcggttcgtagagcattaatttcaatggcaaccattccacaaacttttttttcagcgaaaatgcaagcaattcattcttttttgcctcattctttgcgattaggacaagaagacatttgggagccgactattgtggaaaaattattcgcagaaagccaaattacagaaaaatcgccgttaaaattcacgttaacttacgataaaacggaaatacaagaaaacattgcaagaaaatttattcaacattggtcgcaatcagatttaattcatgtaagagcaaatccggtttcaagagaagaattattgcaacaacgggcaattggtgattttgatattatccgttcaggctggtgtgcagattataaggaaccgtcaagttttttgcttaattttcattctaagagtccggacaataaaacaggctaccaaaatcctcaagtagatcaattactggaaaaagcgttgcagtctttagaagaaaaagagcgtaatattttgtatatggaaataataaaaattttgcaacaagagcaagtggtattacctatttttcagcctcttatccccgtttggcaaaacaacattttgggtattgaacagaacaatgacagtggtgtgatatatagcaaagatttgtatcgacagaacaaagcaagcgaataagaatatcttatttccgcataaataacctatttaacttttaaacatattaaggaattattgtggcattagtgagtttaaccaatggctatctttcttttggtgatcagccgttattagattgtgcagaattacatattgaggcaggtgaacgagtttgtttagtcggtcgtaacggtgcaggaaaatcgacattaatgaaaatattggcacaagacgtcatgatggatgatggacacttgcaatttgaacgagatttgattgtgtctcggttacctcaagatccgccaaactatgcagaaggaaatgtgttcgattatgtagcggaaggtattggacatttagctgatttattaaaagattatcatcgtatttctctacgattagaaaaagaatacagtgaaacattgcttaatcaattagcacatattcaagctgaactggaacataccggcggttggcaatttgaaacaaaaattaaagaaattctaactaaattagatttgaatccagatactttattaaatgagctgtcagggggtggctacgcaaagttgcccttgccaaagcgttagtttgtaatccacatgttttattacttgatgagccgactaaccatttagatgttgacgcaattgaatggctcgaagaatttttattgacctttagtggcagtattatttttatttctcatgaccgctcttttattcgaaaaatggcgacacgtattgtggatttagatcgaggtaaattagtttcttatccgggaaattatgatttgtatttaacagccaaagaggaaaatttacgggttgaagcactaaaaaatgaactctttgacaaaaaattagcacaagaagaagtttggattagacaaggaattaaagctcgccgaactagaaatgaaggtcgtgtaagagcgttaaaagcattgcgtgaagaacgtcggcaacggagagaggtactgggcaaagctaaactacaattagataattcaagtcgctcaggaaagatcgtgtttgaattagaaaatgtttgttatgaggtagcagggaaaaccttgttaaaagatttcacaacgaccattttgcgtggagataaaattgctttagtcggtgtaaacgggtgtggtaagacaacgtttatcaagttgttgttgggagaaattaaaccaacgtccggaataattcgttgcggtacaaaattagaaattgcttattttgatcagtatcgtgccgatctcgatccggaaaaatcggttatggataatgtagctgatggcaaacaagatattgaagtgaatggtattaaacgccatgttttaggttatttgcaagatttcttatttccgcctaaacgtgctatgacacctgtaaaagcactttccggcggagagcgtaatcgcctgttgttagcaaaattattactcaaacccaataatttattaattcttgatgaaccgacaaatgatttagacgtggaaacattggaattgttggaagaattattggcggattatcaaggaacacttttaattgtcagtcatgatcgtcaatttattgataatacagcaactgaatgttatatgtttgagggaaatggcgttctgaataaatatgtgggcggtttttttgatgcaaaacaacagcaagctaattattttgcttgtaaagcagaggaacaagttaagcagaaaaaacatgaagaagagaaaagaggcgtaaattcagtcgttgagaaagcagaatacaaaactcgccaagttaaattatcctataaagagcggcttgaactggaacaattacctcagttgttggaagaattagaagaaaaaatcaccgcccttcaaacggaaattagtgatgtagatttctttcagcaaccgcatgaatatacatcaacaaaattacaaactttagcagatatggagcaagatttagagacggcttttttacgttgggaagaattggaagaaaaaaagaatttagctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttatgccaatgcggcagctttccaactcgccgaggtgtccagttccggtttaggacgagcttatgcgggtgaggcagcgattgctgataatgccgctgttgtggcaaccaacccagcgttaatgagtttgtttaaaacgaaacaattctcaatggggggggtatacgttcaatctagaattaatataaatggtgaggttaatgttaatgtagggaagggaattgtacaagttgcagatgaaaaagcagatcagaaaaaggttgtacccggtgcattagttcccaatttgtattttgtggcacctattaatgacaaatttgctatcggtgcgggtatgaatgtcaactttggattacaaagcaaatataaaaaggattatgatgccggtgtttttggcgggactactgagctgaattccattaatttaaatttaagcggttcatatcgtgtcagcaaaggattaagcgttggtgcggggttaaatgcggtttatgctaaagcaaaaattgagcgtcatgcgggggttctagataaggcaattgatactattgccgattctaagggaatggctgggagtatcaatattccttcattaacatcgttagtcccaattttctcccagttaaaagatagagtgaatacggatactctcttaacacaattacaagataataatgcatggggattcggttggaatatcggtgcggtttatgaatttaatcaaggtaaccgtatcggtattgcctaccattctaaagtagatattaattttaaagatgatgatgcgttgagttatcaatttgaagcaggaaaaattagtcctgttaaagagaaaggtgggttaacgctacatttgccggattatttcgaaatttccggtttccaccaattaacggaaaaattcgccatgcactacagctataaatatactaaatggagccgtttacaaagtttacatgccacttatgataacggtaaggtcgctttccataaagatgaaaaatttcatgacagttcacgtgtagctctaggggcgacttataatgtgaatgataaattaaccctgcgtgcaggtattgcttatgatgagtctgccgaccatccgagtgcttcaatccccgataccgaccgcacttggtatagcttgggtgcaacctataactttacgcctaatctttctgttgatgtaggttttgctcatttacgtggtaaaaaacagcaatttaaggaaaagcataagattggaagtacaggtattgagttcggcagtatagatgcaaactataaatcaacagcacgtgccaatttgtacggtttaaatcttagctaccgtttctaacggctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaaacagccactttaccggttgctccacgccctcgttttcctttacgatgaccaccaaaatagctttcatcaagctcaatctgtccatcaaaaacatcatcggcttcaagggctaaatgatagctgatgacttcacgaattttacgataaaacaaggcacttgaatttggattgatacctaaaatattagctgctgatcgagctgtcacttctaacacaaaaaactcaaggagctttttctgtatagatttctttaatttacaatgagttattttcatttttatagactggcatacttactaatctaatacagccccaaatgttaagtnnnnnnnnnncaagtttcggtttacttgcaagcgttattcttccaaaatctctgcaaaaatctgaatccctttgactcctagtgcggtggctagcccaacgaaatccgctccagcggttttcattcgttcaaaaccggctttgtcattaacaccgcccacaccaataatctgtacgtcttttaattttggttctttatccagcatttgacgcagagtatagacattgcctaatgataatgcgtgaattgctgttcctgccagtcctccaatgcctgttcctgtttcagaatttaatatggattttccctcttgcatcactaatgaagagccaagcgtattagtagaagtaataaaggaaatcggtagcgttttattttctgttagcgattttaatagtccattaattaattcatcatattggttttgataggtaaatggtggaattttaatgccaatcggtaaagcctcttctcctagacttaacttggctaaagtggtttgtaacgcatttaaataaggtaataactcttctgcggcataggcaggcgaaatttttccgggcatattggggcaagaaatatttatttccattgctaagggcatcttcacttctgtttgtagcgtcacgatttgctcatagcattcccctacttcttcaggtgaaccaaacacggaaataatgaaaggcttgttggaagtggtttttaattcatcggagatagtacgaacaaagcgaatggtagtcgctaaattattgggactaagtccaattgtatttaggctggtggtttgttgtggagtagcattgggggtattaacactggctgttttttgtgatgttgaatcaaataatacatattggttttttgtccagtcatgtggatagggaactagcatagacgtgcgagttgtaaccgcacctgtatattgacaagcataaagttcacgtaaattttctaattcggaacaccaagggcaaggggtatttaatagggcagggtgaatgttaagttttttcattttggttttctccataattagatcatagttaataaaaaaggacgctataaatagcgtcccggtaagttaagattaattcttttcagatgtaacaaattcaatagaatggtaactgaatcacaagatttgatgttttttaatgaaaatttatggatatatattaacatgttgctgatgcagaaaaaacattaccatagaaagagggttgaacgtggttgagaaagtcaatcttttatttatacaagatttctaaaccacgttattaaactggggcggtaatataacttatttcagcaaaaatgagaagctaatttagctatattttatctaaaaattttagggtattagaattcagtcaaaattttatcctttgaaagagggtaatatgttaaacatcgacagaaaatggaaaagtgcggtaacaataccaaatagaataaccagtagaatagtgacgtttccgcctgcaaccataaatccttgtttaccattaggtaattgacgtgatttgtaagccaataatgcagggataatacaagcccaaattgttgccaccgcacctgcataaccgatagctttcaaaaaacctaatgggaaagcaactgataatattaatggaggaaggaaagttactgcccaagattttgttctccctattttgttgtcatcaaatttaaataagtcagccaagaagtcaaatacacctaaacctacaccaatgaaagaggatagaattgcagcaatggaaaaagcattaatagcttgtttaactgatgcggattcaattacatttcccaaagctttgagtaacacatctaaattgccatcactggcaataattggtgaaaattgatttcgtggcagattaccaaaaatagaaattacccatagtaaatagagtgcaagagcaatggtggttccgcctaaaatagctaatttggctttatgttcatttttatagtatgcacgcattgttgcaacagagtggtgataaccgaaagatgttaatgcaacgggtaataaacccattgtgtatatgacatagttattatctgagccagtatttgtattaaataaaatggctaagtcaatatttttagttaagccaaatacactaagcataaaggaggtcgtcataaaaataattaatataatggaaatgcgatcgacaatgcgagtagaatgccaaacaaagaaagagaatatcaaaacgaagataattgaccaaactcgagagtcaatgttgaacatttcatttgttaatccacttaggatgccacctgatgctgtagtataagcgtacagtaaaatacctccaacaaaataaacggataaattgttgatgatgttgacagtattacctaataggcttttggttactgtattaaaagaagctcgtaaatcaaaatgtttataagcctcaagtaataaccaaccggataacgtcatgcaagtcatcgtaaatccaatggtgaggacagaccaaatagtccaagctcctgcaccggatgtaggtaagcctaacattccggcaccgacacagacactcgcaataatgcaagcaccaccgaaaatagaaggtgatttttgcataatatagctccttttgaaaactataaaaaaacaccgcattttttgttaaaagtgcggtgccaaatttaaatctcttttaatcgagcggtgaaatgacgcagtactttaggttcataagtgaaatctaaacctttgatattttttgcattctctttcactcgtttgaatgcttcaataatgaagtccatatgtgtttgagtgtaggtcgcacgaggaatagttaaacgtaacaattcagccgggcaaggtaattgttgacctgttttcggatctcgtcctaataggagagaaccgatttctacggatcgaatacctgctactttatataattcacaagcaagagcctgagctgggaattgttctgctgggatatgtggtaataatttgcctgcatccacaaaggcggcatgtccaccgggttgttgacaaacaacaccgatcttttctaaaccttgtacaaggtattcaatttggctaatacgataagctaaccaatcttgacgcataccatcacgtaaacctacagctaggcgttccattgcaccaccttctagaccaccataggtagggaaaccttcttgtacaacacaaagtgtacgacactcgttgtaaacatcttccattgaattatctttgaagcagagtagtccccccataggtaccattgcatctttttttgcagacatagccaaggcatctgcatatttatagctttcgtaagtgatttgttcaatagtccaatctttgtattctgcttcacgttgttgaataaagtaggcattttcagcgaagcgagccgaatccataatcacaggaatatcatatttacgtgcaatttggtacatggctttcatattggcaagagataccggttgtccaccggcagaattacaggtaatagtacatacaatgtaaggaacattatttgctccaacttctaaaataccctgttccagtttttctaaatcaaaattacctttgaaatcatgatctacatctgtgtcaaaagcttcttttatatagacattacgtacagttgcaccatttaattggctatgaccttgagtagtgtcaaaaaaatagttagagaaaacaaccattttatttctatccaaccctttttcttgctcacgttttttgatcaagacaggaatataaatttgttctgcaccacgaccttgatgggttggaattgtgtattcataaccaaagatttctttcactgcattggcaagagcatagtaactgcgacttccgctataagcttcatcacctcttagcatggcagcctgcatatcttgagtaacggcacctgtaccactatcagttaatagatcaataaaaatatcttcactgtctaataaaaatagattcatacctgcttttaagatagcttcatcacgataggcacgagttgtacgtttgacaggttcaataacacgaatacggaacggttctggtaaatgtttgaaattttccatgattaaatcctcaaataattaattaaaaaatgtatattacaaaaatattattaggattgaggagttatgggaaaatacagggatagctttggatctacaagtatccaaacttgatttggtgataaaacatttaccatagcttatccctttttagaaatgaaatgtaatttatctcagacgaggaagatagtaacttagcaattgcactttgtcatatagaatgttttaaatttgtgaactaagtcaaaaattttgataaaaaataagactctacttatagagtcttatttttatgaaagtgcggtttgtttccgcaaatttttattgtgtcgcttgaattgcagttaatgcaatagtatacacaatatcatcaaccaatgctccacgagataggtcattgaccggcttacgcataccttgtaacatcggaccaatagagactaaatctgctgagcgttgtactgctttataggttgtatttccggtattgagatctgggaagacaaatactgtcgctttaccggcaaccggagaatttggtgctttagattttgctacatcttccattactgctgcatcatattgtaatgggccatctattaataaatccgggcgtttttcttgggcaatacgagttgcttcttttactttctcaacatcagcaccggaacctgacgtgcctgttgagtaagagatcatcgccacttttggatcaataccgaatgcttttgcggaatcagcagattgaattgcaatctctgccaattgttcggcagttggatcaggattaactgcacagtcaccataaacaagcacttgatcaggtaataacataaagaagattgaagaaacaattgagttaccaggtgctgttttaatgatttgcatcggtggacgaatagtattcgctgttgtatgtatcgcacctgaaacaagtccatcgacttcgttagcctcaagcatcatagtgcctaatacgacggtatcttctaattgctctcgtgcagacgtttcagtcatacctttggctttacgtaattctactaaacggtctacataattttcacgtacagagacaggatcaattattgtaataccttttcctaatacaacgccttgagcatcagcaacacgtttaacatcatcaggatttgctaataagatacattctgcaataccacgttctgcacaaagactagcagctttaactgtacgaggttcatctccctcaggtaatactattcgttttttggctgcacgagctaactcagttaattgaaaacggaatgcaggaggagataaacgacgaggacgagttgaggcggcaactaaattttcaataaatgaagatttaaattgttggcttgtgtattgtttaatgttttcgatgcgttctttatcatcaacaggtacttcaaggttgaagctttgtagagccaatgcactttgccatgtgttaccttcaattcgaaaaataggtaagccggtattttcaaatactggttggcatagttttttaatttgattgtcaattttgtaaccacctgtgagtaaaataccacctagctcgatcccgttagtcgcagcaagtgcggaggcagttaggacatcaggacgatcagcggaggtaactaacagactacctgttttgaaatgctcaaccatattttgtaatgaacgagcacagaaagtaatactacgaatacgacgagttttaatatcgccctcatgtagaatagaagcacctaaatgattgaccaaatcaatagcacgagttgcaataagctccgcattccacggaacgcaagctaatactttaatagggcttttttcaaatagcttgtaaacctcattaaggttattttgtttatgttggtaagcatcaaaaatttcacttaggtctggacgagtacgtccggattcatcaattggtgcattaaatttattaattatgacaccaagtaagtttggattattttttccgccaaattgagaggctgccgcttcaatgcgttcttttaactctgccggcgtttctgttgcaggtgctgcaactaatacgatttcagcatctaacgcctttgcaatttcgtagttgatactgtttgcatagccatgcttgcgagttggaactaagccttcaacaataatcaattcattatttttagctagttgttgatgattttcaacaatcttttccagtaacacatcggattgattttgaccgattagattttcagccacacttagcataaacggttcggctgtttcaagtgttgtactggtacgcacaattgaagtagtgcggtctaatttatcttcatcggtacttggttgcgaaattggcttcatgaaaccgatttttgcccctttttgctcaagagcgtggattaaacctaaacttacactggttaaaccaacaccggtgctaataggaataaggataattgtacgagacataaaaaaaccttaaataatgttgttaaaaaagaaactgccgaatttatcggcagcctgtagattacaattagaaacttaaacgagcagtatcttgtgcaattacaagttcttcgtttgttggaataacgattgcgattggcgtattatccgctgtaataacaccttcattaccaaaacgagctgctgagtttttctcatcgtcaattttataaccaaatagttttaaatgatttaaagtaatttgacgaaccaaggcggcgttttcaccaataccgccggtaaagacaatcgcatctaagttttcgccaataatagccatgtatgaaccgatatattttgctaaacgatagcagaatacatctaatgcacgttttgcagcactttctttttcatagttatcttcagaataacggcaatcactcgtgacttctgttaaacctaacaaacctgattttttaactaaagtttcctcgatctgtgctactgacatgcctaacgtattgtgcatgtaaaaaatgattgctggatcaagatcaccggaacgagtacccatcaccaagccttccagtggagtaaagcccatggaagtatcaatacatttaccttggcgaattgcagcaacagaggcaccgttgcctagatgacaggtaattacgtttattttatcttcagcaatatttaaacgtttggcagcttcacgactcacgaaatagtggctggttccatgcataccataacgacgaacgccatgttctttgtataaagaatatggcagagcgtataagaatgcttcttctggcattgtttgatggaaggctgtatcaaatacggctacgttattatcttttaaatgaggaaatgctttaaatgcttcttcaataccgatcaaatgtgcagggttatgaagaggagcaaattcagcagcatctttaataccttggataacttcatcggtaataacaacagatttggtatatttttcacctccatgaacaacacggtgtccaatggctgcgattgaatttttaagatcttcagttaagatagttgaaacgataaagtttaatgcttcactatgtgctgcaccagcacctaaatctgcattacctttctcaccgttaagtttccacttaattcgggcatccggtaggtagaaggcctcggctaaacctgataatttttcagcacctgaaactggatcaagaatagcaaattttaaagatgaactaccgcagttaagaattaggactaatttttgagacatacgagacctattttgaaagttaagttaaaaaataaattcatttactcaacaatattccaagtaaatgaactgacatgaaagtctttgccctgcatagaatacacttttcagataataaaataaattggtaaaatcaaaaaatacgacttttatcaaaaaatgtatcaaactcatcgtttaattttcttgataaaaataatagatttttttataaataattctaaacgaatatgtatcaaacactaaaattaggtcaacgttatttggaaacttggccttcaatacctaaactgagtattatttttcctgaaaatcgagttattaaggtaacattatttgcacaaaaatttatgccgtttttagcagtattttcattagtttggcaacaagtttatataaaacatgatttggttgctttagctattgcagttttaaccgctttgtttgcgttgagcttgccattacaaggtctatattggctaggtaaacgctcaaagttgcctttacctccacaaacaaaggtatggtttgataagatagttgaggtgttacagcaaaaaaatactaatcttgtttctattgagcaaccaacgtatcaggatttggcagagttattgcgtaaggctgaacagaaattagatactgagttttggcagagtatttgagcgaagtttatcgctaaacagcaagtgatatatctaatgggttgaatatagtaaaattttccccgcacttggttatcaagtagcttattttttcactatataaggaaagaaaatgctttgtgctatttacaagactaaaagaaaagaagggatgtatctttatattgaaaaacgggggcattttgattccgttccatcttccttacttgagtcattcggcaagccaatttttgtgatgttatttaatttagcaggacaaaaatcattgattaatgctaacaatgaagatgtgcaacaacaaattaaacaaaatggattttatttgcagatgccaaaacagcaagaaaatttacttgaacaagaaagacagtatcttaagcacaataaatgacataatcaatgatatgattttttaaaatttttaccgcactttgacacttttgaaaaaataaaggcgatcatagatcgccttaaatgtataaattatgctacacagactgtttcggttggtcaaataccgtcactttcggtgcagtttctgtgtatttttccacttgaacaatacatgtattcggggaattaccttgtgctaattttgaagtaccttcatcacgtgtcagtacgttggcacaaccatttttacataaaggttgttctgattgacctaaatcagccggatcataccaagccccctcatgtaatgcgaccgtacctttaataattccttcagtaactaccgcacctgccaatacttgtcctcttttgttgaaaatacgaacaatatcaccatccatgatgccacgagccattgcatcttctttatgaattagcacaggttcacgatcgtttactgcatattttttccgtaatgatgtgtgagccaattgactgtgtaagcgatagtaaggatgtggtgtaactaatgctaaaggggcttccgtcgttgtattacctgcaaattcttcaggaacaaaccaatatggatgacctttacaatcatcataattcatttttgcgacaacatcagagtaaatttcaatttttcctgatggtgtaccaagtggattcagtaaaggatcattgcggaatgcttcgtaacgtacccatttttttgatttttcagttggtttaaagttaacaggtttattttcttgccagaatttttcaaatttcggcataagtacacgatttttacgtgctgcattaaatgccacgttgtaaaaatcttgcaaccattccatttccgtttttccttcagtaaatttgtcttctactcctgcacgtttggctaattctgcaaaaatatcatagtcatttttcgcttcaaattgtggaggaacaacttgtttcattggaaaaatattcatcatggcataatcaccggacatagttaagtcgttacgttcatagctcgttgtggctggtaatacaatatccgccatgcgagcagtcggtgtccagttaacttcattgacaataacagtttcaggtttttgccatgctttcactaatgtatttgtatcttggtgatgaacgaaaggattaccacccgcccaataaattaacttaatgtcaggataggtcactttagagccattataatcaattgtttttccgggattcagcaatacatcagcaatacgtgctaatgggaaagagaattttgatgtatcatcaagccatgttttttctccggcttgtactgatggattagctgtaattgaaccaataataccaccgactgcggaaggtgcaccaccattagaataatgataactgaaaccaaatccgcctccaggtaacccaatttgtcccagcatcgccgctaaagtaactaatgtccagtgagtttgttcaccatggcgttgacgttgcataccccaaccgcccattaacatagtacgttttgacgaaaaatcagcagctaactgtttgatgatatctgcaggtaatccacaaattttgcttgcccaatttgcgtctttcggttgaccgtcagtttttcctaataaatattgttcaaatttatcatagccagtagtgtattttttcaagaatgccttatcatgtttatctgtagtaaccaacgtatgtgcaatccccaacattaaaggaacatcggtgcctgtatgcacaggtaaccattctgcatttaagaattcacagctttcacttctaaccggatcgatacaaataatacgtttaccgctttctttcaattttttgaaatattcaataccttgttgatcggtagaagtccatgcaattcgcaaagtcgtaagaggattagccgcccataacacaacaatatctgaactttctaaaacggtttcccagctggtttgttgttcataaacttcaattgtacctaatacatgaggcataattacttgtgccgcacctgttgaatagtcccctttgactccgacaaatccaccggtaacattcatgtaacgctgtaacaaagtacggctagcatgtaatgcacctgagctataccaaccataagaaccggcaaaaataccgcctgcaccataagcatcacgaacacgtttcatttcacctgcaactaactcaaaggctttatcccaagaaacacgaacccattcatcacgtccacgcaaactggtatctttattaccctccaaaaatcctttacgaaccattggatattttaccctcgtttcactataaagttggtcagctactacgctttgtaattcattttcgactgaaattggcattgcagatcctgatttaactaccttgccattttctacaactacacctaaagccccccaatgagcagctgttacaacggtatgttgttcagccgcaacagctttcgaagctaatgttccgacaacaccgccacttagagatacgccagccacgcctaatgatgaattttttaaaaaatcacggcgacttgtattaactttattttgtgttttcattttaaacctcgttatttactaggctcacaatgaactggtgaaagaaaagacatcgaaacggttagaaaacacaccgcactttctccaacacattgtgaaagttttattttcgacacctttctaaagggagtggcacaaccatttctagttataccatgtgcaacatttgacaatgttacaggcttgcaaccttattttgcaacttaggtcaacaagctcggagtcgtcagttttttcaaaaatttcagcgtttccctcaagcttggcttaatggctttttccgccgaaatctttagcattgcgttgtaaatagattgttactgaacgaatatcatctgctgtcattgatgtacgatctttcatcgaatttaccacgccaatccattgatttgcggtgtaatgatctgccccgatcggtgcatgacaaccgctacaatgagtttgatttaaattatgaccgaattgatttaatgcctctaaattggacgtgagcatattttttgccacttttacttcaatcgtaatttctttccaatcagaatccgtgacgttgtcatgaacagtttgtaatacggtcgcatttttttcaattccatcacctaaagccaacataatgcgttgccctaattgtgcatagactattgtttccgcccctacttgttgccagccgtgaattgtgccgataacattgtcatcttgcaatttccaatcattcacttctgcaaacggcattaaccgcacttcatcgccttgtgccagctgtgccggactcattgccaaactatataatattttatcggtttgcttaaattctcctgcatgtttagttaattcaccatatgcggctgtatcatcaacctctatttcaggcataaaatgagcaatacctttatggcaatcaatacaagtttgatttgtttcgatgccggttttgtgcattttttgtgctgtcggtgtttgcgaagacatttccattgcttcgaaactatgacaactgcgacaagtggcagaatctgattcttttaaatcttgccaaacggacttcgccatttctaaacgatgcttttcaaatgcttcttcatcaggcaatttatcagtaacataagtatgccaaagatctttcactgcaaagacttttgttttcacataatggaaaacgttatcttgcgggatatggcaatccgcacattcggcacgaatcccttttcggttagagaaatgtatagaggcttcccattctgcttgaggttgttgcattgaatggcaagaaacgcaaaattcagtggtgctggttgctttcattgcatactgtactcccgctaaaataatcacccctaataacacaccaacgattccactaaacagccattttttatttgattttgccattcgcgtttcccccaagaataaaattcaataaatcaattacaacaaaaaaatcatactcttatattgtaacgatatgatgttggtaattcactaggcatacacgaaaaataacggctatttgcaccattcttgacgtagatcaatatttaaatttaagagtgaatatgtgaaataaaatgcgtaattttatgtggcatttttagtattttctcccataaattgaaaggattgatatggtacaattttgttttttatcttatgcagaggaaaaggataggttcttttttgtgccactattaaggttaaaggagaaaagcaatcttgttgttttttttcactcaaattgacttgatcgagtatttcaaaatttaataattttatccaatcaaggatacgccaagtgaaatattgtttaaagggaagtgcggtttgatttttatgatttaaattttgtttgaaaattaatgggctataagggttaaataaggaaataaagagataaccgtcattttctaaaaccctggctatttcacctaataattgatgggaatgttgcgtgaagtttaatgtattggctaatacgcaagcgtgaatagattgttgtacaaaaggaagttgtaatggatcagcttgtatcagactaatttcttctgttacgttttgattagctggaaaaagtgcggtaggatttttcgtcatttccggcatgaggattattttgtggcgtaaaggtaaattgagttctaattctgcacttaatccgccaatcatgagccactgatcgcctaagactttttgaaaccaatctgcaaaaaattcgttgattaggctacaatacattgttcctttttggatatgttgccaactcatcggcaatcgataattttttactgattttatgttgaatttcatattttctaacttgataccctttggaggagcttgatgttaattcctattcctgcacttaatgataactatatttgggtgtataaacgagagaatttatctgtaattgtgatcgatataccggaaatagctgcattatctcaatttatacaggcacaaaatttagtgattggagctttgctgatcacacataaccatagggatcatattggtgctttggctgaatttaagcagttttatcctcatgttcatatttatggtccggcagaatgtgccgatcaaggggtgacacaagtcattgatgcaggaaggttaattattgatgaatatcatatagatgtattaccgactggcgggcatacggcacagcatcttagttttttgatagatggtcatttattctgtggagatactttattttctgccggttgcgggcgtgtttttacgggagactattcgcaaatgtttacttctttacagttactcaaatccttgccggatgaaacaatagtttgcccagctcatgaatatacgttaggcaatttagcgtttgctttaactacaggcaaaaataaaagtgcggttcaaaagcaacttgaaaaagtaaaaaaactaagagcagaaaataagcccagtttgccgacaacattggcattggaaaaacaaattaatccgtttttacaagttgagagccttgatgagtttattgaattgcgtaaagcaaaagatgttttttaatttaaattagacattctattgtattaataggtaatcgaatttgctcaatgtgggacaatttattagaatagccacgttttttacatgaattttccaacaataaattatttatgaccattcttgttctcggcattaatcataaaactgcctctgttgcactgcgagagaaagttgctttttctgacgaaaagcgtttgttggcgttgaagcaaattaaacaaactcagctggcagaaagtgcggtgattttatcaacttgtaatcgaacggaagtgtatttacataataaaaatgttggacctcaaaatgatgaagtctggttagatagttgtgttcaatggtttgcagatattcatcaagtagatttagaagaactgaaaagttgtttatatagtcagcagaatttacaagcatctcgtcatttaatgcgggttgcttccggtttagattctttaattctcggtgagccacaaattttaggtcaagtaaaacaggcctatcaaatgagtgaagagtattattcactgcattctgatattggcatgatgagtactgagttatctcgcttatttcaaaaaacttttgctacggcaaaacgagttcgtactgaaactcatattggagaaagtgcggtatcggttgcttatgcagcctgtagtttagctcgtcaaatttttgatagcttacgcaatttgaatattttgcttgtgggtgccggagaaaccattgaattagtcagccgtcatttattgcgtcatggagtgaacggcttagctattgctaaccgtacgttatctcgtgcggaaaaattggtggaaaaactggaaacaacacaaaagatagatatttttagtttagacagactttcggaagggttaaagagagcagatattgttattacctctaccggcagtcctcatgttttaatctcccgaaacttgattgaacaggcacagcaaatgcgtcattacaaaccaatgctgattgttgatattgcggttcctcgtgatgtggaggaaagtgcgggggaaattgaatctgtatatcattacactgtagatgatctacataatattattcaacataacatcaaccaacgtgaacaagcttctcaacaagctgaacatattattcagcaagaaagtgcagatttctttgaatggcttaaagtacatcaattttctaatttgattcgcaattatcgagaaagtgcggagataattagacaagatttactcgaaaaagccttgcaggctctgcaaaatggtgagaatacagagcaagttttacaagagttgagtcacaaactgactaagaagctgatccatcaacctactcaagctatgcaaacgatggtaaaagccggtaatacagaaggtttacaggctttttctcatgcagttaagtcctaggaaagtacaatttatttaagtttatccagttttgccaataaaataggtgctggttgttgttgaattttatacatacgccaaagcagtaaaatagcagcgattgttaaactcactacaaaagatacccaaaagccggcagcaccgatacttggaataatccagtcggttcttgataaggaaaatcctaacggcatgccaatgccccaataacaaaaaagggtaatgtataaaatagcttgtgtatctttatatccccgtaatgcaccactggaaactacttgagctgtatccgaaaattgataaagtgcgacgatcatcagcagactacttgatatagcaatcacttctttatcatttacaaaaattgctgctatttcatagcggaagaaaaagatgatggatgccgtcaggaaagcaatagataaacctacagtaagagcagagaaagatatctgcttggcattatctattttgccttcgcctagacgttgaccaacaagaatagtagtagccatacctaaagacataggtaacataaatgcaaaggagctggtatttagtgcaatttgatggcttgctacaacttgagtaccgagaggtgataataatagtgaggtaagtgcaaataatgccacttcacaacataaagaaaccgcaataggcaatcctaaacgaaataattttgccaaagttttcatatcaggtttttcaaataaatgttcaaaaaccttgagatcacgttgatttctagcatgcttactatagacgatcatcattaagcacattatccagttgacaatagctgttgcaatgccacaaccaaccacaccaaacgccggaatacctaatttgccgtaaataaaaatatagtttagagggatattgcacagtaagccaaaaaatgtaatcaccatagccggttttgttttggcaatgccgtcatttaagcaacggaagttaattaataataaataaccaggtaatccccataacattgcacgtaaataactgatagtaatattggcaagtttttcttccattttcatatattgaatgacaaaatcgctattgtagattaataagccaagaggaatacagctaataaaaacaatccataagccttggcgtatttgatgagcaatatgatctcgttgtccggaaccatttaaataagagattgttggaggcaaggcaagtaataagccatgtccaaataatactaggggtaaccaaatagatgccccaactgcaacggcagccatatcagctgcactaacacgtccagccattattgtatctactaaccccatggaattttgtgctacttgtgcaagtaaaataggggtagcgatggcaattaattttttagcttctgtgtgatattgttgaaaacgagttaatttcataaaaatccgattttgctataatattggaaatatttatttagagagaactttatatgtttacaggaattgtccaaggaacagcacaaattcagtctattattgagaaagctaattttagaacacaggtaattaaaatgccacaggatttattagcaaatttagaaattggtgcatctattgcaaataatggtgtttgtttaacggttacagaaattaagggtgatttgattagcttcgacttaatggcggaaacattacgtattacaaatttaggtaatttagcggtaggcgattttgttaatgttgaacgtgcaatgaaaatgggggatgaaattggcgggcatattttatctggtcatgtttattgcactgcaacaatccaaaatcgtattcaagcagagaataatttgcaaatttggtttgaaatgcctacagctgaattaatgaaatatgtgttaactaaaggatttattgctattgatggaattagtttaaccgttggcgaagtcaaagggcagtgcttttgtgtgaatttaattcctgaaacaattaaccgcactttgattgcaaaatatgatataggtgatttagtcaatattgaaatagattctcaaacacaggcggttgtggacacagtagaacgctacttggcaaacagataaattcattttgcctaaaatctaaaattgtgggagtgtactctcacaattttatctatttatagcgtttttttgtgctttgctcatctaaattatgcaatcgtgctaatttttctttaagttgaatttccagtccacgatctgtaggaaaataaaatttcgtatcttttaattcttctggaaaataattttctcctgccgcataggcattaggttcatcatgagcataacgatattctgctccatatcccaactctttcattaaatgagttggtgcattacgcaaatgtaccggtacatcataatccggcatttcttttgcgagtttttttgcttgcttaaaggcaacatatacagcgttacttttaggtgcaacagctaaatatacaatcgcttgtgcgatagcacgttcgccttcagccgcaccgactcgggtaaaacaatcccatgcagcaagtgctacttgcattgctctgggatcagcattgcccacgtcttcagaggcaatggctaataaacgccttgcaacatagagaggatcgcccccagctgtgataattctcgcataccaatataaagcggcatctggtgcggagccacgaatagatttatgtagagcggaaattagatcataaaatcgatccccttgcttgtcgaagcgagcctgtcgttcccctaatacttcagttaggagacgatgattaatcaatttccctttttctgtttcatctgccatatccaccatgagttctaaacaatttagtgctaaacgggcatccccattgacatattcagctaaggtttcaagaacattttcagcgaaaatcaaccgctcttttcccaatccttgctctgcatcttggatagcattttgtaacactgtcacaatattagatgtagttaaaggtttcaaaatataaactttgacacgagagagtaacgcattatttaattcaaatgatggattttctgtggttgcacctataaaaatgatagtgccgttttcaatatgaggcaaaaaagcatcttgttgggttttattaaaacggtgaacttcatcaacaaataaaatagtttgttgacccattaaacgattttgttttgcccgttcaacactttcccgaatctctttcactccggcggtaactgcagaaatacgctcaactggagcatgaatttgttgtgcaataatctctgccagcgttgtttttcctgtaccaggcgggccccaaaaaatcatagaatgaatatgtccgttttcaatggctttatatagtggctttccagctccgattaaatgttcttggccacaatattgcttcagtgtttgcggtctcatttttgcggctaagggttgaaatgccgagtgagagaaatcaagtgaaaaagtggacatataaaactccattaaatgattaaaagtggacgtttattacgtccaatcatttcaattttaattaattattttttacgttgatcgtcaaattcaacgcccttaggcaaggtaaatgtgaatattgcatcatttaaggctggattggtaatcttacgcagaatatacaagttactttgcccatctttctctattgtactaaaattttttaatacaccatctttttcaattcgaatattaaattgcttgatggtacttttcttagatttgggtttaataataaacgtatcggatttttgctcaacaatatattgttgccaatgacttggattattacttgttagcaaaacaaagggggtatcgcttaaggtatcttcaacccaatttgctgttacttgctcaacaaaaggatcgtagaaccataatgtttttccatctgcaataatttgactttcttgaggtgtttcattgtccatacgaaataaattaggacgtttgagttgtatttttccactaccttgctgtattttttttccctgtgcatcagtcacttgttgtgtatagtcagcacttaacacatcaattttatttaaacgattttgtaactcattaaccgcatttgcccaagttacattactgatacctactaataaaagtgcggttaaatttagatattttttcattatttgtccttttcaattgagaatgaattgattcgatataatcaaaaggctgaaatgttgtataacatatcataaaagataagtataaaccctaaaaaataaataatattccgttcagtttatgatactgtgatctagtgcaaagaaaaatttttttcgctagctataatacaacttggtagtttaacagtttatttgaggagtatttcttatgcaaaattgggcacctgaggtatggcaaagtgcattaattggtttatgtattggagtttttatcggttacttattattgcgtttcactaaaggaacggtcaaaaaacagataaaaacagaggctgagttggagcaagtgaaaattcaacttaacaatcagaaacgacaattagagcaacattttgctgaaagtgcagagttgttaaaaaatattgcacaggattatcaaaaactttatttacatttagctaattcatctacaacactattgcctgaattggcacagaaagaattattttcaccgcatttattagccacggaatctatttcgtcacaacaagataaatcaaaagataatcagcctagagattattctgagggttcatcaggtattcttaaagctgaaaaataactatttctaaataggcacattgaggtgcctattttgctgtttttctttaatctctttgcatttctgaaacttttttgtattttttctgtcttaaattagcgatatgtatgatttaaatggagaaaaaagtgaaaaaatctagctttgttttaaccggtattgctttagggttaagtgttctaacaacatcaattaatgttcaagcaattttgcctatggcagttgatggacaatctcttccaagcttagcaccaatgttacaaaaagttttacccgcagtagtttctattgcggtagaagggaaacaaaaaaatgatttttctttcaataatgaaattcccgaagagtttcgccgtttttttggtgacagctttggttttgaaggatttagcagtcgtgcaccgcggagttttcgtggtattggatccggagtgattattgatgcagaaaaaggttatgtattgacaaataatcacgtgattgatcaggctgataaaatcacggtcaaattagaagatgggcgtgaatttaaggcaaaggttcttggcaaggatgatatgtcggatattgcacttattcaattagaaaatcctaaaaatctgaccgcagttaagatcgctgattctgataaattaagagtcggggattttacagttgctatcggtaatccattcggtttggggcaaaccgcaacatcgggaattgtttcggcattagggcgttcaacaggatttgatagcggagcttatgagaactatattcaaactgatgctgccgtaaatagaggtaattccggaggaccattagtaaatttaaatggtgagcttatagggattaatactgctattatttctccaagtggcggaaatgcgggaattgcatttgcgattccaagtaatatggcaatcagtttagttaagcaaattattgaatttggcgaagttcgtcgaggattactcggtattaaaggaggtgaattgaatgccaacttagcaaaagaattcaatattgatgtacaacaaggtgcgtttgtgagtgaagtattgccaaattcagcggcagaaaaagccggacttcaagcgggtgatgtgattacggcaattgatggacaaaaactggcaagttttgcggagttgcgtgcaaaaattgcaacaagtggtgccggtaaagaaattaaattgacctatttacgtgacggtaaatcgaaaactgcgaaagtgaaattgcaatctgatgatggagatacaatttctgcagttggcaacatttctatattagaaggtgcggaattaagtaattataatcaaaaaggcacaaaaggcgttgaaattaaagaagttaaatcaagatctcttgctgctcaatatggtttagaaaaaggcgatattattattggagtgaaccgccataaagtagaaaatttatctgatttacgtaaaattttaggcaaaaaaccttcagctattgccttgaatattttacgagatgacagtcgtttttatttattaatccaataattttactgaacctataattcttattaagacaaaacgaaatccgcactttaaagattgaccgatcaaagtgcggattttttgtgtttaaagatgatgttcttgtctaatttttttgagtaacgcatcgcagcatttatccagtaattgataagtctgctgaaaattgccggtataccaaggatctggaatatgatcacaagctaaatcttcacatatcgtggttatttgaaaaagtttagatggtgctttcgtaaagaatttttccaaatcatgtagattgttgttatccattgcgattaaataatcaaattgttgccaatcactattacgaatttttcggctggtaaaccctctgttatcaatagcatatttggtaagaatctttgccgtttcttggtgcatattttctccatcatgccaaccggaagttccggcactatctgtaaaaatttgattatctaaatgagctaatcgaattttttcacgcataatatattctgccattggggagcgacagatattacctaaacagacaaataaaattttaatttgtggtttcatgttaagcctttgccttatgatgaataaaagtgcggttgtaattgtacatgttttgtgccaatttagataagtttttattagcaataatctatggtaatattcgcttcccctttattttaaaagtgactaatcatgtctttaccaaaatatgttgaacaactgttaaaagagaaaagtaatgttcgggtattctcgtttaaatatgatgggaaatcttattggctaaaacaaaccgaaaaactttcttttatttggcggttcttgaaatccaatccagcggaaatgttaaaaagtgaaattattcgcttacaagaacttaataaaaaatcagcacctgtacctaagttagttttatttggtgataacttttttgtgactgaagatgtgggaagtagtgcaaatacttgggttgaaaatgaggatttatctattgaattaagaaataaggttttgtttgattgtgctcaagcattggcaagtttacataaacaaaatattactcatggtcgcccagccttgagagacatgatttggtgtgaagaaaaagttatttttgttgattttgaatgtacctcgtcaagtaataacatagattggcaaaaaattcgtgatggattagtttttattcatagcttaggacgttcttcaactgtttcggatgagcaaatagcattaactgttactcattatcgtcagtattgtgatgctgatatttggcagaaaactgctgattttatctataaatatcgttgggcatattatgttcttcgtattttcaaacctgttgcaagaatggatttaattgctatttatcgtttatttgaagctattttaaaaaatcaggaaacattatgataaaaaaaagtgattgtatggagtatttgtgcggtttggtaatggcagtttaagtgttaggggcatagtaatagtattcgattttttattaaattgtttataacatcaacaaataacaataaattagtaattttatcttgctattttttttatgacagatataatgtgacgcatatttcggacgcggggtggagcagcttggtagctcgtcgggctcataacccgaaggtcgttggttcaaatccagcccccgcaaccactttacatagaagttttcgtaaaggaccccactgtgacttggggtttttttatgcgagtaaacttgagatttagtaaacgggctgatagccctttttttacatctgtttgttatgaaatgtagaaaaaaactcaatcttacgtgttattttgagaggagaggatagtggcaacattagaggataaattacaagaattattacaaccttcagtagaggatttaggttgtgagctttggggtattgaatgccaacgttccggacgtttttttacagtacgtttatatattgataaaaaagatggcggtgtaacggttgatgattgtgctgatgtcagtcgtcaagtaagtgcggtgctggatgtggaagatcctattgcggataaatataatttggaagtgtcttcgccaggcttaaatcgaccattgtttacattaaaacaatttgagaattatatcggacaggatatttctgttcatttacgtgttcctatgtttgaccgtcgtaaatggcaaggtaagttagagaaaattgaaaatgatatgctgactttgattgttgataaccagccacaagtattagtttttggcaatattcaaaaagccaatgttgttcccaaattcaattaattagagagacaaaaatgagtaaagaaattttattagccgctgaagcggtttccaatgaaaaattgttacctcgtgagaaaatttttgaagcattggaaagtgcaattgcactttcgacgaagaaaaaatatgaacaagaaattgatgttcgtgtagtcatcaatactaaaaccggtgagttttctacgtttcgtcgttggttagtggttgaaacagtactcaatccaacgaaagagattacattagaagcagctcaatttgaagatccggaaataaaattaggtgactatattgaagatgaaattgattcgattgcttttgatcgcattgcgatgcaaacagcacgtcaagtaattagtaccaaaattcgtgaagcagagcgtaataaaattgtggaacagttccgttcacaggaaggtgaaattgtttccggtacagtgaaaaaagtaaatcgtgattctattattttagatttaagtcaacaggctgaagctgttattttgcgtgaagatatgttaccgcgtgaaaatttccgtccgggtgatagagttcgtggtgtactatacaaagtaagtccggaaaacaagggtattcaattgtttgtgactcgtgctaagcctgaaatgttagtggaattgttccgtattgaagttcctgaaatcggcgaagagttgattgaaattaaaggtgcctcacgtgatccaggattacgtgcaaaaattgctgtcaaaagcaatgataagcgaattgatccagttggagcttgtgtcggtatgcgtggctctcgagttcaagcaattaccaatgaattggggggggagcgtgtagatattgtgttatgggatgataatcctgcacaatttgtcattaatgcaatggcaccggcagatgtgagctcaattgttgttgatgaagataatcattctatggatattgccgttgaaccggaaaatttagcacaagctattggacgcaatggtcaaaatgtacgtttagcaacacagttaactggttgggtcttaaatgttatgacaatagatgatttaaatgctaaacaccaagcggaagataacaagattttagctttatttatgaccgcactagagattgatgaggagtttgctcatatccttgttgatgaaggattcactaatttggaagagattgcttatgttgctgtaaacgaattaacggcaattgatggcttagaagatgaggatcttgttgaggaattacaagctcgagcgaaaaatgcgattactgcaaggatgttagctgaagaagaagcattgaaacaagctcatgttgaagaaaaattattaaatttagaaggtatgtctcgtcatattgcatttagattatcagaaaaacaaattacaactcttgaagaattagctgaacaaggtgttgatgatttatcagatattgaagaattaagtgctgaacaagctgcagatttaattatggctgcacgtaatatttgttggttcaattaggaataaagagtaataagattatggcagatgaaataaaaaaagaaaatgcacccaaaaagttgagtattcaacgtcgaacaaaaactacagtgagtggaacaagtacaacgggaaaaagtaaagaggttcaggttgaggtgcgtaaaaagcgtacagttactaccgatcttgaacgtaaagctcaagaacaagccaaattaaaagccaaagaggaagcagagaaaagagctgccgaggaaaagcttgctgaaaaagcgaagcgagaagcggaaaaagctaaagctgagcaaataaagatagagaaagctaaggctgaacaagctaaagcaagtaagaaaaacgttgatgtagaaaaagaaaaacgtcgagcggaagaggctgagttacgtcgtaaagccgatgaattggctcgtcagaaggcagaagaaaaagcacaaaaagcggctgaagaagctaaacgttacgctgattttgatgagggtgacaatgataacggtaagttggatgattatagcgattatcacttaacttccagctatgcacttgaggcagaaaatgaagaagaacgtcgtaatgaaaatcgcggacgtagtaaaaataaagtagttaaagctaagaaaggtggacgagatgatgaaaatggtaataaaaatgaacgtcaatcagatcgccgtaaccaaaaagatgtaaaaggtaagggaaagcacgctaaaaaagccagtgcgttacagcaagcatttactaaacctgctcaagttgctaaagctgacgtagtgattggtgaaactattactgtggctgagcttgcagcaaaaatggcagttaaggcaacagaaattatcaaaaccatgatgaaaatgggagaaatggtaacgatcaatcaagtgatcgatcaagatactgcacagcttgtagctgaggaaatgggacacaaagttattctacgaaaagagaatgaacttgaagaaatggtcatggaggatcgtgatgtaaatgctgaaaaagttcatcgtgcaccggtggttactattatgggacacgttgaccatggtaaaacttcattacttgattatatccgcaaagcaaaagttgctgcaggtgaagcgggaggtattacccagcatattggtgcttatcatgttgaaactaatgatggcaaaatgatcacctttttggatacgccggggcatgctgcatttacttctatgcgtgctcgtggtgcgaaagcaacggacatagttgttttggtagttgcggcagatgatggtgtgatgcctcaaactattgaagcgatccaacatgctaaagccgccaatgcaccattggtggttgctgtaaacaaaattgataagccggaagcaaatcctgatcgagtagagcaagaattactgcaacacgaagtgatttcagagaaatttggtggagatgttcaatttgttccggtttctgcgaaaaaaggcttaggtattgatgatttattggaagcaattttgcttcaatcagaagtcttagaattaaccgccgttaaagatggcatggcaagcggtgttgtcattgaatcttatttggataaaggtcgtggtccggtagcaactattttagttcaatccggtacattaaaccgtggtgacattgtactgtgtggttttgaatatggtcgtgtgcgtgcaatgcgtgacgaaaatggtaaagatattcaatcggcaggtccatcaattcctgtagaagtactaggtctttcaggtgttccggcagcaggcgatgaagcaacagtcgtgcgtgatgagaaaaaagctcgtgaggttgctctttatcgtcaaggtaaattccgtgaagtgaaattagctcgtcagcaaaaagcgaaactggaaaacatgtttagcaatatggcagaaggtgatgttgcagagttgaatgttattgttaaagcggatgtacaaggttctgtggaagccattgttcaagcattacatgaattatcaacggcagaagtaaaagtaaaagttgtgggttccggagtgggaggaatcactgaaactgatgcaactcttgcagctgcttcaaatgcgattatggttggtttcaatgttcgtgctgatgcaacagctcgtcgtgtaattgaaaatgaaaatattgatttacgttattattcaataatttatgaattactaaatgaaatcaaagcggcaatgagtggtatgttacagccggaatttaaacaagaaattatcggcttggctgaggtgcgggatgtattccgtcatccgaaattcggtgcaattgccggttgtatggtaactgaagggctggttaaacgtaacaacccaatccgtgtattacgtgataacgtggtaatttttgaaggagaacttgaatctctccgtcgttttaaagatgatgtcagtgaagtacgtagtggtatggaatgtggcattggcgtaaaaaattacaatgatgttaaagtcggcgatcaaattgaagtctttgaagtagtggaagttaaaagagcgatttaatttgtaaccggtaatataattttgttggttgaattataactaaagagcgagattatcatatattaagttgcttaatgtttttgtggataagaatgcccttaactttgttttttaaggttaagggcattggagttttatcatgttttagaagagaaactgcgtatagtggtaaaaattaggaaaactcaccgctctttttaaggtgtaatttctcaactctagagtgaatttaccaacattaatggagaaaaatatggcaagagaatttaaacgtagcgatagagtagcacaagaaatacaaaaagaagtagcagttattttacaacgtgaggttaaagatcctcgtattggtatggtcacggtgtcggatgtggaaatatcaagtgatttagcgtatgcaaaaatatttgtcacttttttatttgatcaggatgaaaatgttattgagcaaggtatgaagggattggaaaaagccagtccctatattcgtagcttattgggcaaagtgatgcgtttgcgtattgtgcctgagttacgctttatttatgaccaatctttagttgatggtatgcgtatgtccaatcttgtgacgaatgttgtgcgtgaagatgaaaagcgtcatgtagaagaataagcgaataaaaatatgagtaaaccacgtaaaaaagggcgtgatattaacggtatttttttgttggataaatctcaagggatgagttccaatgatattatgcaaaaagttaaacgtcttttccaagcgaataaagcgggacataccggtgccttggatccgctggcaacaggaatgttgccaatttgtttaggtgaggcaacaaaattttcacaatatttacttgatgcggataaacgttatcaagttatcgctaaattaggcgagcgtacagatacttctgatgccgatgggcaagttgtgcaaaagcgagaggtcaatattgatttagcaaaaattttgaccgcacttgagcaatttcgtggtgaaattatgcaagtgcctactatgttttcagcattgaaatatcaaggcaaagctttgtatgaatatgctcgtgcaggcattaccattgagcgtgaagctcgtccaattagtatttttgaattgaagtttattgactatcaaataccttatttaacattggaagtacattgttctaaaggaacttatattagaaccttagtagatgatttaggtgaagtattgggttgtggtgctcatgttactaggttgcgtcggattgctgttgcagattatccttataacaagatgatgacgttagaacaattgcagcaattctctgaacaggaagatttggatttattggatcaacatttgttacctatggaaagtgcggttattcgtttacctggattgcacttaacaaaagaacaggcaagagctgtaggatttggacaacggattaagtttttaaatgaacaaggcatacaaggacaagtgcggttaatttctcctgaaaatttatttttgggtgttgctgttattgatgaaaacagcattgtccatcctcagagaatggttgttattaaacccgaataaatccaaccgcacttaagggcagatttattctgcccttgttttgtcaattaagctaattccgctcgtaattttttagtgaccgacatcatcacttcaagttgtgcaatggtctctgaccagccacgtgttttcaatccacaatctggattgacccataaacgctcttttggtacaacgttaagagctttgcgaagtaaatgttcaatttcttctgctgttggtacacgaggactatgaatatcatacacacccggtccaatatcgtttggatatttgaaatcaccgaaagcggttagtaattccatatcggaacgagaggtttcaatggtgatcacgtccgcatctaaagctgcaatagccggtaaaatatcgttaaattcagagtaacacatatgagtatggatttgtgtatcgtctgctacacccattgagcttaaacgaaacgcctctcctgcccattgtaaataagtatcccaatcggctcgtttgagtggcaatccttcacggatagcgggttcatcaatttggatgactttgattcctgctttttctaaatccaatacttcgtctgaaagtgccacaccaatttgcttacataccgttgaacgtggaatatcgttacgtacgaatgaccactgtagaattgttacaggaccagtgagcatacctttcatcactttcttggttagactttgtgcatattttgaccaacgtactgtcattggttcaggacgaacaacatcaccataaattacaggcggcttcacacaacgtgatccatagctttgtacccaaccaaatttagtgaaagcaaaaccgtctaataattcaccgaagtattctaccatgtcattacgttccggttcaccatggaccagcacatctaaatccaatttttcttgttcacgcacaacaagttcaatctcttttttcattgaattttcatactcttctaaagagagatcgcctttcttaaacgctgctcgagcacgacgaatttcggtagtttgtggaaacgaaccgatactggttgttggtaagagcggtagatttagccaagcattttgtaatttgatacgttcaccaaaaggtgatttacgttgatcggcattttttggcaaattagctaaacgttcagctacttccggacggtgaatttcttttgaatttgcacgagcatctgctgctacttggcttgcatctaattctacatttaccgcattacgacctttttcaagagcggtttttaagacgcttaactcttgtactttttgtaaggtgaaagctaaccagctataaagagcagggttgttctcttgtaattgggtttcaacatttaaatcaaatggtgtatggagtaaggaacagcttgtagcaatccataaacgctcacccagtttttcttttagtggctctaatacatcaagtacagtatttaagttagctcgccaaatattacgtccgtcaattacgccggcagacaataccttgttgtaatcttcgaatgctactagttgctccggagcacgaactaaatctaagtgtaacccatctactggtaattcttttaataaagtagcgtgttctgttactgaaccgaaataagtagctaataataatttcgcattcactttttcagatagcgttgcgtaaacgtctttgtacgcattaacccactcttttggtaaatctaccgctagtgcaggttcatcaatttggatccactcggtaccttctgccacgagtgcgtttaaaatctctacatacacaggaacaagttgagcgagtaattcaaaacggttaaaggattcgcctttctctttccctaaccataaaaatgttaaaggcccaacaattacaggtttaacttggtgtcctgcaactttcgcttcacgaatttggtttacataatgtgttgggtttgctttgaattgtgtgtctttatgaaactccggtactaaatagtggtagttggtatcaaaccatttggtcatttcaatagcaaattggtctttgttacctcgtgctaattgaaagtactgatcaagtgtcaaatttttactatcgaaaccgaaacgagcaggaatagctcctgttgcgacttgaagatctaaaatatgatcataaaaggtaaaatcacctactgccacaaaatccgcattggcatcagcttggtggttccaatttttttcacgtaatgccttagctaaatctaatagatcttgctcagccaactctttacgccagtaacgctcttgagcgaattttaattctctttttgctccaacacgtggaaaacctaaaacgtggaatgttgtcataactaaatctcctgtatggtaagtacaattttgaatagacgtctaaacgtctgtgttttggtataatgcaataaaagtctttaatgatgcaatctcataattttcacgttttgtatgaaaaaaattaataaaagagcggtgtaatttaggtaagattaatagaaaaaagtaatgagcatgaagaggttgttattgaggcgtttttttatgggcttggtttagcctcttcaacaggtgcagatagaacatcccaaatagatggctttggctcttcgggaatgtcattacaaaaaaactgatcgttatttatccaaactggaagctttttaggacttgagcaattccagtttccataagagtctataccaatccattcaattttagctggtgtttgtggatttaacatttttatttcagcacgagataaataatcttgatagatttttaatgcaccactcgcaccggttaattttgttgttacattatcatctcgccctaaccatacagtaacaacattctcaccatcaataccaacataccaagtatctcttgattcatttgttgtacctgtttttccggcaagtttaagtgaagcgtattgattttgtaagctacgagctgtccctcgttcaacgacttgttgcatagcaaataaggtttggaaagctgcttcttggggaacgacttgttgtggcattattgaacgttggtaaatcagattcccctgcttgtctgtaatactgtcaagagttgacaacggaatatgttttccttcattggcaatagtttggaataattctgtaacctcataaggggaaatagagtaactacctaacaaagttgaaggcacgttaggtatttttacattatcccaacccattgccatttgcatttcaattactttgtttaagcctactttcataccaatattaactgttggaatattgagcgagcgaacaagtgcatctattagcatgacggaaccactgtattttctatcgtagttacgaggctgccatggctgagttcctttgatacgaattgtaataggctgattttgaataagcgtattaaggcgaaattgctcaggatcagataacgccactaagtaaattgacggtttaactaaggaaccaatttggcgacgagcgtgtaaagcacggttaaatcccgcatagtttgtctgtaaaccaccaacaatggcttttacttcacccattttataatcagcaataatcatcgcactttctaaatgtggatttttatattttcgctgtaattctgagactgcttttatcacggatttttctgcatgttcttgttgtttcggatccaaagtagagaaaattcttgcaccggataaagaggaaagtttgttttcgcccagtttgcttcttaattcttgctgtagagtttgaataaatgccggatacttgcggttaatttgtcctcttttttgtacgctgagaggacgtttactgagtaagtcatagagttcattactaatcattttatgactgagcattaattttaatacaacattacgacgttctaaggccttttgagggttacgccaaggattgtatagtgaaggaccttttaccatgccaaccaacaaggcaatctgatccaaactgatttcccgaacaggtagcccaaaataaaaatggcttgccaattcaaatccatgaatttgtgtgttgccattttgtcccaaataaatttcattaagataggtttctaatatgcgatttttatcgtaacgaaaatctaaaatcaaagccattaatgcttcattcattttacggcttaatgtgcgttcgttgcttaaaaataaatttttaaccagttgttgtgtcagtgtacttccgccttgtacattatgtcctgctttgatgttggtaattaaagcacgaataatgccaagtaaacttattccatcatgttcataaaaatggcgatcttcggttaaaagtaaagtatcgatcaataatcttggataatgttgtagcggaatagctagacgttcttctctatctgattgcaacatcgcaataagttttggatcaagacgaaactcactgatggtttttacattgatcaggtcttcaatgatagaaagtttattatcattattaaaacgtaggcgaaaaaggcgttgtgcttcaggttgacttgggaaagggaaggctctgcgtaaaataaccaaagtgttattttcaattttaaaatcacctggcgtggcaagcatggtcgtttggcgatattcattttctaacagtgcttgtttgatttgttccagattcagttgatcagataaacgtatgttttcaatacgactataaacctcggcgggtaactgccaaatttgaccatccattttattgcggatttttccgtctaaataaataccataaaatgcaattccacataatagagtaaaaccaagttttgcactaaaaataaacaaccgttgttttttatttttctttttgggttgagttgtatttcgtttttgtttcgcagccatttttatttagtttaagcaataaaagagagataggattttagaaaatattcaaaatcttctaagccacaaaaagcaatactttcttcatcataataatggaaatcagcttccagttcatcgtgttcttcaattgctaaattattggctttaatcataacttcatctgaatgaataaaaacagaaaattcgtttccaatgagactaaactccttttcattgcgtgattgttttgcttgttgcagataattaagtgcggtaggaatcaagtcagaatttaaccgcacctctatattgaaccaattagctattgcctcatgttccatagaaaaattaactgttacttgatcagcgttgtgagtaaattgatagtccattgtttagatactaaaagatgagccgcaaccgcaagttgttgtcgcatttgggttattaacaataaatcttgagccttctaaaccttcggtatagtccacagtaccgccgattaggtattgtaaactcattggatctacaactaatttaacgcctgcattttcaatgattaaatcaccgtcattagttttttcatcgaaagtaaagccatattggaaaccgctacatcctccaccggtaatataaactcgtaattttaattctgtattttcttcttctgaaattaaggttttgactttatttgccgctgcatcagtaaatgtcaaaggaactgcaatatctgccatagtattttccgataataaaaattagtgggctattatctaataaccaaccaaaccattcaagatttataaaaaatttaatgttataatgcacgacaaattttatgtctagagaagatattatggcgattccattaagaacagaacaagaaataataaagttacgtacagcttgtaaattggcatctgacgtgttggttatgattgaaccttatgttaaggcaggtataacaaccggtgagttagatcgtatttgtcacgaatatattgtgaatgagcaaaaggcaattcctgcttgtttaggctattatggctttccgaaagcaacttgtatttcattaaatgaggttgtttgtcatggcattccgactgaaggcaaagtgttaaaaaatggtgatattgtaaacattgatgttacggtgattaaagacggctactacggcgataactcaaaaatgtatattgtcggtgaaaccaatatccgcagtaaaaaattagttgaggcggcacaagaggcattatatgttggtttacgagtggtgaagccggggattcgtttaaatgaaattggtagagcagtgcaaaaatataccgagagtcaaggcttcagtgtagtgcgtgagtattgtggacatggcattggtaccgaatttcattgtgatcctcaagtgttacattattatgctgatgatggtggtgttattttacgggagggtatggtttttactattgaacctatgattaatgcgggcaaaaaagaagtgcgtttaatgggcgacggttggacagtaaaaaccaaagatcgtagccattctgctcaatatgagcatcaacttgttgtaacgaaagatggttgtgaagtgatgacgattcgtgaggaagaagaaaaagtcggacgaattagtagaataatggttaatatatagtatcaattcaacgtgcaatcttttcaaggttgcatttcttttatttcaggacatgctatgttttcttatcttccaattccaaatccaacgatagcaacaataaaagcacaaaaagaacagcttaaacagtttgagttgacatattttcagcgattttctgttgatcaactcattcgtaatcgttcagtattttgtgatcagttattaattcacctatggcaaatttttcagcttgagaaaaatcacttaacccttgttgcagtaggcggttatggacgggaagaactttttcctttatcggatcttgatgttttgttgttagttgaagatgaacctactatcgagctggaggaaaaaattgcacatttttttcggtttctatgggattgtggatttgaggttgggcattcagtacgcactttagcccaatgtgaacaaagtggacgagaagacatcaccattgcgaccaacttattagaaagccgatatttatgtgggcaacaagatttattcgaaaaattaaccgcacttttgcaacaaaaaaatttttggcgaaatgaggatttttttaatgctaaagttgcagaaaaagttacacgctatcagcgttaccataataccggttataaccttgaacctgatttaaagtatagtccaggaggattgcgtgatttacatcttatttattggttggctttaaagcatataggtgctaaaaatttagaagatattttgcacgctggttttatttatccacaagaatattctttattaaagcaaagtcagcaatttttatttcaagtgcggtttgctttacatttaattttaaaacgttatgacaatcgcctgttatttgatcgtcagcttaaagtttgtgaattattaggttttgttggtgagggcaatcaaaaggttgagaaaatgatgaaagtcttttttcaagcttcacaatctatttctgtattaagtgatattttggttaaacattaccaagagcattttttagccggttcacaaattattgagcaacaagttttagattccgatttttatcttattaataatgcaatttgtgtaaaaaatcctgatatatttattcaaatgccggataaaatattgatgctattttactatttgacacaacactctcatgttgaaattcattctgcaacattacgcaagttgtatattgttactcaacaatttactgggaatttatctgattttcctcttgcaagagaacgttttttacgtttattttcacaacctaattctatttctcgtgctttgttaccgatgcataaatacggtgtattgaacatttatttaccacaatggaaagggattaacggattgatgcagtttgatttatttcattcttatactgttgatgaacatactttgcgagtgatgttaaaattagaagagtttttagcggaagaggcgaaaaaaaattatccgatctgccacaccattttctcatcattaactgaccgcactttattatatcttgccgctttatttcatgatattgcaaaaggcagaggaggggatcatgctgaattaggtgcagttgatatgcgtatttttgcacaacaacatggctttgatagtcgagaaagtgaaactatggcatggcttgtacagcgacatttgcttatgtctgttactgcacagcgtcgagatattcatgatcctgaggttattctcaattttgctgaagaagtacaaaataaagtgcggttagattatttaacttgtttgactgtggctgatatttgtgcaacgaatgaaactttatggaatacttggaaaagatccttatttacgactttataccaatacagcctagatcagtttcaacaaggaatagatattttattaaatcatcaagaaaaagctgaagaaaaccgcaaacaagcgtgtattttattacaacaaaagtatggatttttatctgaagctcaaattgagcatcactggcaagattttccttgtgagtatttttggcgtaatagcccgaagcaaattgcttggcattctgagttgttacttgataataatcaagatttattgattaaagtcagtaatcgtttttcttatgcagggacagaaatttttatttattgccaagatcaagcgaatttattttataaagttgccagcattattggagcaaagaaattgagtattcatggagcacaaattatcacaggaaaaaatggctatgtattcgatagtttgattgttaccgagttggatgggggcttgctgaacaatgatcgtcgccgtcaattggaaggtgcattaattaaaggattaaaaacaaacaagattgttaacccagttcgtataaataaccataaattacaacatttccatgttaaaacagaagtcagatttttaaatgttcataagcaagaacaaactgaaatggagctttgtgctttagatagagcaggtttattagcagaaattagtcaaatatttgtacaattggagttgaacttattaaatgcaaaaatttctacaattggtgaaaaagtagaggattttttcattttaaccaataagaaaaatgtagctttaacggaacaagaaaggttacgtttacaagatcgtattgaaagtaattttagctaaagataaatgtctacattgcatagattttttatgctaaaatccgcaaccgatttattttattgctgaataggaaaaagaatgaaggttttagaaggtatagttacagcacctaatgccaaaattgctgttgttattgcacggtttaatagttttattaatgaaagtttattagagggagcattggacgctctaaaacgtattggtcaagttaaagatgaaaatattactttcgttcgtgtaccaggagcttatgaattgcctttaattgctcgtcgtttagccgatagtaaaaaatatgatgccattgtggcgttgggtactgttattcgtggcggtacagcacattttgaatatgtagcaggggaagcaagtagtggtttagggcaggttgcaatgcaggcggaaattccggttgcctttggtgtattaactacagaaaatattgaacaagcaattgagcgcgcgggaactaaagctggtaataagggggcggaagctgcacttgttgcattagaaatggtgaatttgttagctcaaattgacaaggcatagtagataaaatgacagaaaaagtaaaaaaaatatccccacgtcgtcgagcaagagaatgtgcggtacaaaacctttattcttgggctatttcaaaaaattcacctgaagaaatagaattaaacttcattgtggatcaagataatgagatgaaaggcgtggatatgccgtatttcagaaagttgtttcatcaaacaattaaccatgttgaaactattgatagtacaatggcaccttacttagatcgtgataatgttgagttagatcctattgaatgtgcaattctacgtttagctgtttatgaattgaaatttgaattggatgtaccttataaggtggtgatcaatgaagctattgaggttgctaaagtatttggtgcagaagaaagccataaatatattaatggtgttttagataaaattgcacctgcactttctcgtaaatagataggtttatcataatgagcaatggcgaatttgatattattcaacgctatttcatcggatcaaaacgtccacaacgtaaagatgtgattgtttctatcggtgatgattgtgctattactgaacattatcaaaatcagcgaattgctattacgactgatacgatggtagaaaatgtccattttctgtcttctattaatccttcggatttagcatataaagctgttgcaacaaatttaagcgatcttgctgcaatgggggcgactcccgcatggttttctcttgcaatcactttaccttatgttgatgaaaaatggctcaatgaatttagtcaaagtttatttgatgtattggatcattataatgtgtcgcttattggtggagatacagcaaaaggtcccgtatatacaataactattactgcacaaggcatcgtacctaaagggaaagcactttgtcgccacagtgcacaagatggtgactggatctatgtttccggcacattaggagacagtgcggcaggattggaattactattaaaaaatacagaggaaacgcatagtaaaagtcatcaaagtgcggttgattctgcacaagaatatttaattcaacgccatttacgtccaacccccagagttttgcttggtctggaactagctagtgctgagttggcaaatgctgcgattgatatttctgatggatttattgcagatttaggacatattttacagcgtagtcaatgcggtgcagtgatcgatttagataaattacctttatctgagcaattaatcaaaactgttggtatagagcgagcggagcgatttgctttaactggcggagaagattatgagttgtgctttacagttcctgatcgcaatcttgaaaagttagagcgagctttaacccatattggtgtgaattatagctgtgttggacaaattcgtaataaaaaacgtatcagttttcaacgcagcggtaaaactgttgagattggttcattactcggctttgatcattttaaataagatttcattatgacaaataatcctttatctcgtatttctttaaccaatcctattcatttttttgcacttggcttaggttcagggcttattcatcctgctcccggcacttggggtacccttgccggattaattgttggttgtttgctattacagataatgtcggtgttttcttttgcaattttcactgcactttgttttttattaggatgttatttgtgtcaacaaacagcggatgatatgggcgtacatgatcatggctcaattgtgtgggatgagttcgtcggtatttttaccgtgttactcgctattcctgaattatcattgatatggtgtagtattgctttcgttgtattccgtatttttgatattttaaagccttatcctattcattattttgatcatagattagaaagtggcttcggtattatgttagatgatgttttagctgctatttatacggtcataagtatttctatcttaaattatctcgtgtagaggcgattgattatgctgaatttattattggttaacttatttgggttacttaccccgggacctgattttttttacataagtcgtttagcagctagtcattctaagagaaatgccatttgtgctgcgtttggtattagcttgggttgtttagtttggtcaacttcagcaattcttggactggctgttttattgacaacttacccaagtttgcaaggcattattatgatgctaggtggcggatatttggcttaccttggtgtattaatggtgaaaagtcataacaatattgtctttgataatcgtgaacaagcagaaaatttaagaaacagtatgggtaaagaaatcttaaaaggattattgattaatttatctaatgcaaaggctattatcttctttagtagcgtgatgtcttttgtattggttgatttaactgaaacatggcagattattaccgcacttattttattaactcttgaagtatttttgtatttttcttttattgcacttattttttctcgtaaaaccgtaaaaaaattttatagccaatatagccattatattgataactttgcagggatcttttttctttgttttggcggttatttaatttatagtggtcttttcttaggatttggcaattgataaatagagagggataaaatgacgttaaaaattggtattgttggttcgggtggtcgtatggggcgtcaactgatacaggcagtatatcatactgaaggcgtagaacttggtgcggcatttgagcgtgtcggttcatctttagttggaactgatgcgggagaactggctggaataggtaggattggtattaaagtaaccgataatttaactcaagaaaaaggtaactttgacatcttaattgattttactcgaccggaaggtaccattcagcatttagcattttgtgtagagcaacataaaaatatagttatcggtacaacagggtttgatgatcaatccaaacaagctattcaacaagcagcacagaatattgcaattgtttttgcctctaattatagtgtgggcgttaatttagtttttaagctgttagagaaagcggctaaggtcatgggcgattattgcgatattgagattattgaagctcatcatcgtcataaagtagatgcaccttccggtactgcactatctatgggggaacatattgccaaaacgttaggcagagatttaaaaacgcatggcgtgttttctcgggaaggtattacaggtgaacgtaagccggatgaaattggattctcaacaattcgtgcggcggatgttgttggtgagcatacagtatggtttgcggatatcggtgaacgagtagaaatatctcataaagcctccagtcgaatgacttttgctaatggtgctgtaagagctgcaaaatggctttctactaagcaagaggggctttttgatatgacagatgtactggatttaaataatctgtaagtgcggttagatttggttcttgaaaattgcacatctttgatctttcagtattcgtcatttaagatgttgctaagatgttgatggaataaaatcaatgccaaaattttagccagtccgaaaaatgggtataatgcccactgatattatatattttaggaatagtagtatgaaatttatttcatttaatattaatgggttaagagcaagacctcatcaacttgacaggattgtagagaaatatcagcctgatgttattgggttacaggaaattaaagtgtctgatgaagactttccctatcatcttgttgaacatttaggctaccatatttatcatcatgggcaaaaagggcattatggtgttgctttgttattgaaacaagaacctaaagtaattcgtagaggcttttctactgacgatgaaaatgcacaaaagcgtataattatggcggatttagaaacagattttgggttgctaacagtaattaatggttattttccgcaaggtgaaaaccgtcagcatgaaacaaagttcccagccaaagaaaaattttatacggatctgcaacattatgtagagcaagagcataacagaaataatccaattttaattatgggagatatgaatatcagcccgacagatttagatattggtattggtgaagaaaatcgaaaacgttggttgcgtacaggaaaatgctcatttttaccggaagaaagagaatggataaatcgtctatataattatgggctgattgatacatttcgtcataaaaatccgacaatcaatgatcaattttcatggtttgattaccgctcaaaaggctttgatgataatagagggttacgaattgatcatattttagtgaatcaattattattagaacgttgcgttgatgccggtatagcttttgatattagagcgatggaaaaaccatctgatcatgctccgatttgggcggaatttaagtgaggaacatagaatgggaattgaacaagaatggcaaaattatcgatctaaaattaatgataaattagccgtattttcagttaatttaaaacttcttgaacaatttccagtcgtaaatcatatatgtgaaattgttgtccattttgaagtcccttatatttcagatgcacaaggcttaccgcaaatagaaagttacaccggtttgcaacaagatttgctcaaaatatccagtttaatttctgcccaacctaatgtttattacgcaggcaatattctttgtaatggcaatgctacattgtatttctattgtaacgatgctttagatattacagatgtattatctgataattttccaaacgctgtaaatattgagaaacaattcgattcaacgtgggatctatattttgattttttgatggcatctcaggcagatttgaaagtaaatgcagcagaagaattattggcaactttaattgaaaaaggagaagatatctcgaaaagttatcaaattgagcatactttttacttttacaaagaaaatgatctttacttatttttggagaatattgctacttctgacatatcatttttatcgctaaaacattcttctaagcaaataaatatgaatggatataatgtatatattgctaaaatagagcaagaattgtatttaaatgatgccagtatttatcaatatataagaaattttgaagaactcgctttgcaacattcaggtgaatatattggttgggagagcgaagatattggtataaataaaaatcaactaaattaatttttaaatttaaaaaaccttacaacagaataagatgtaaggtttttaatcggattaaagcaccttgacaatactttcacataaataacgaatattatcttcagttacaccggctaaattaatgcgtcctgaacgtacagcataaatggcaaattcttcttttaagcgatccacctgttctgcatttagaccactaaaagagaacataccattttgttcaataatgaagctaaagtcttgcttggcaccatattcttttagcaattcaacgaattgataacgcatacgtttaatgcgattacgcatttcggttaattcggattcccattgttgacgcaataggttatcacctaaaataatagaaacagccgtagcaccatgagaagctgggttagagtagagagtacgaataattgatttcacttgtgttaatgctattgctgaaatttcttctgtttctgctactaaagtaaaggcaccaacacgttcattgtataaaccaaagtttttggaataagaacttgcgactaataattctttatgattttctgcaaaagttcgcaaaccaatagcatcttcttctaacccgttagcaagaccttgataggcaaaatcaaagagcggtaaccaaccatttttttctgacatttctgctagtattttccattgctcaggggttggatcaatacccgttgggttatgacaacaaccatgtaataacaccacatcaccctcactggcattgcttaagtcagcaattaaattatcccaatctaaagcttttttctccgcatcgtagtaacgatattcacggattgtcatacctacagcgttgaaaatagcattatggtttggccaagttggtgaactaatccaaacgttttgagatgtggtttgacgtttgataaattcggcagcaatacgtaacgcaccggttcctcctaaactttgtactgttttagcacgtccttgtttaataattttagaatttgtaccaaataataattctttagtgtatgaattaaactctgcaataccatcaatagttaaatagtttttagtggtttctaattcaaatagacgattttcagcttctttaacagctttcataatgggggtgttaccattagcatctttatagaccccaatacccaagttaattttattggcacgtgtttcagatttaaaagcctcacctaaacctaaaattggatcagcgggtgcagcattaatattctcgaacatagtagtatcctcaataaatagttgtgtttgaatagatttctttatactggtaaaaacttatctttgcaaccctttagctaagttaaatttaattatttaattttaactttataaaatatattaaaaattatttgctagattaaattatttcaatttttccaatgcccaatctaaaccaaattgataatcttgcggtagtatgtagcgtaatttttgtaaattatctattaaaatagatggagttggatgagataaattaagatgcccaactttacgaccttctcgtacttcttttccataccaatgtaattgtgaaaatggcaaatttaaccattgtggattatgttcagtgccaattaaattcaccataaccgacggcatagctacttgtaaatcaggcgtaggtaaatctaataacgcacgaagatgtaattcaaattggctaatcgaacaacctaattgcgtccaatgtccgctattatgtactcttggtgccaattcattgactaataattgatcttgcacaacaaaacattccattgccattacgccaacataatctaatttatccataattttagccaacattatttcggcttgtttttgttgttgtgactgttgtggaaaatttaaattcatgacactgtaacgtaaaataccattctgttgcagattatgcgtaacaggataaaaacgagttttgccatttttaaaccttgcaccaaccaaagaaatttcataatcaaaaggaataaatttttcggcaataacttcgccaaaaagctcattgccgattacatcttgattgtttttatctacaatccattgtcctcgtccgtcgtaacctcccatgcgacgttttacaacaactttttcaccaatttctgtaaaaatagtgaaaaaatcctccgcactttgtaccaacctccaaggggaagtaggaatatttagtgcgttaagcaaggttttttgtgtaaaacgatctgctgtagtggcaaaaattttttgattaataaatttatcgtgattagccaacatttctgtaaggggtgttttttcccaacgctcaatttctgctgtaataatactgtcagcaggcaaatcaaaaacaggtgcatcaaaagcaagaggttggacattaatatctaaaggtgcacccgcataacgcaacattctgcccaattgcccattacctaaaacatacactgtaggatataaagtgcggtttaccattaaatgatccttatacttaattaagatattgtaaatttttatttactctgattttacttgatgaggttttagtagtaactcatcttcgttcaatttaaataattttgctattgtatcacgatatgatatttctaaagtttctcggctggttgccgttacaccttgatcaattaaaaaaccgtcgttaacatcataaatccagccatgcaaagaaagtttttttccacttttccaagctgatttaacaatagatgagctgcctaagttatacacttgttccgcaacattaattcttgtcaacatatcagcgcgtttttcgggagataacttacccaataaatgaccatgtttaaaccaaatatcacgaatatgtaacaaccagttattaatcaatcccagatcttgatccaccatagcggctttaataccaccgcagttggtatgcccacaaataataatatgctcaatatttagcacatcaacagcatattgcaccacagataaacaatttaaatcagtatgaataacttgatttgctacatttctgtgcacaaacaattcaccgggctttaaatttgtcaaattttccgcaggaacacgactatcggaacaaccaatccataaatagctaggtgtttgattttctgctaacgctttaaaatactcagcattttcttctttcatcctatttgcccaactaaaattattggcaaataactgttcaatttttttcatttttttaccgctcctaaagatgcacagtatagcctagaatagaaaaacggtaaaataaaaagccctgtaagataacagggcggcgaaatttaggtaggattgaatatcatcacaacaatgtcgcttgtttcattttttgcacgaattctgccaattcggagaggcatttttcttgatctgtgagatttcgttcaataatttgcactatagctgaacctgaaattgcaccggcaacgcctgattttaacgcatctttaacttgttgtggttgagctatgccaaaaccttgtaaaatcggagctgagccatatttttttaagcctttgatgagattagctagatttttcgcactttgttgattttcagcacttgttacgccagatcgagaaactaaataaatgtagcctttgcttttttccgccactgctttaagggttgtttcatctgcattgggtggacagataaaaaccggttgaatgtcatatttttgagcggattgaatatacggttcagaagcaagcagaggaatatcagccaccaataccgcatcaactccgacttcagcacagcgttgataaaatccatctaaagtttgagcataaattaagttggcacaaaggagtagactgatcggaatatcgggatatttggaccgcactttggcaattagttgaaaactttcttttgtactgcagcctgcgtttaaagcacgatgattagcagcttgaataaccgaaccgtcaagtaaaggatcggagaaaggaaacccaagttctaaagcatctgcaccgttatccactaaggtacaaataatttcaaaagagcggtcgaaatttggatcgcataaagtaacaaaaggaacaaaagcaccttgtttttgcttttgtagttgtaaaaatttttgttcaaaatatcccatcagataattcctttctcggttaaaattttatctacagtaaaaatatctttatcgcctcgacctgataaatttactacaagtaattgttctttttccggattttgtacaatgagttttaaagcataagccaaagcatgtgagctttctaaagcaggaataataccttcatgtttggctagggcttgaaatgcctcaattgcttcatcgtcagtaatactttcatattgagctcgcccaatagtatgtaaataggcgtgttcaggaccaacggatggaaagtctaagccggcggaaatagaataagattcctcaatttgtccgtcttgagtttgcataatcggggatttcataccaaagtaaatgccaatggagccatgacgaagtggtgctccatgctttcctgtatgaataccgttgccggcaggttcaattccaataagttgtactgatttttctgcaataaactcagcaaacataccaattgcgtttgaacctccacctactgcggcaataacagcatcaggtaagcgattttccttagctaaaatttgacgtttagtctcttcaccaatcattttttgaaattctcgcacaatagtcgggaatgggtgcggtcctgctgctgtacctaataaataatgggttgtctcataattagctgaccaatcacgcatagcctcacaacaagcatcttttaatgagcaagaacctttttcaacaggaataacttcggcacccattaaacgcatacgaaatacattcggcgattgacgttcaacatcttttgctcccatgtaaactcggcaaggcatatccaacatggcacaagctaaagctgtggctacaccgtgttgccccgcaccggtttccgcaataatacgtgtttttcccatacgttttgctagcaaaatttgccctaatacttgattggttttatgtgccccgccgtgaagtaaatcttcacgttttaaatacaattttgtttttgtacctttagtgaggttgcgacataaagttaacgctgttggacgacccgcataatttttaagcaaatcttgaaattcttgctgaaacacaggatcgtgctgtgcttcaacaaaagccttttctaattgttttagtaccggtaccagaatttccggtacatacattccaccaaattcgccaaaatagggatttaaaattgtacccgtcatattttttccttattgattttggattttgtcaaaaactgtttgtaattttatttgatcttttatgccgttggcacattcaacacctgaatttaaatcaatccctagacaatgttgttgcaatgcttgttcaatattttgaatatttattccaccggcaagcatgactttgtatttaatggagggaggaatataattccagttaaaagtttgtcctgtaccaccttgtcgattatctgccttactatcaaaaacataacgatctacataaggaatttcttcaaaatctaccgcacttttcccttgttcatattgctcggtaacgtcaatcgtaacagctttccaaatttgacattgtgtaggtagaacttggcgaagtgcggtaataaattcagcattttcatcaccatgtaactgcacggcgaacaattgtaattgtgtagcgatgttatggataaacgcaatagactgattttggaaaacgccaacaaaaagcaaaggtgcttgcttaaccaatttctgtgcttgacatagggagagtttacgaggagaactttcagcaaaaatcaatccgccgtataaagcaccttgagcatagcttgctttgacatcttgtccacgtgttaaaccacaaactttgtgttcacccaaaagtaccgaacgtacggcattgttaagatctttaccactagttaaactgctaccgattaaaaagccatgtacataaggttttaattgttgtacttgttgatgagaagaaatacctgactcgctgatcacaatgcgatctgccggaatttgtcttgccaaaggaggcgtgcggttaagatctacggagagatcgtgtaaatttcgattattaattccaattacttttgcacccagttttatggctcgttctaattccttttggttggatgtctcagttaaaacacccattccaaggttatgtgcaagatcagataaagtgcggtaagtttcatcatcaagtatcgacaacatcaataaaattccatcagcttgataataacgtgctaaatacacttgatatttactcagtataaaatctttgcaaagaataggttgagtagcctgcttacgtactaaaggcaagtagttaaaatcgccttggaagtatttttcatccgttaaaacagaaattaccgaagcataatttttatagacatttgcaatttctactatattaaaattagaacgaattaaacctttcgaaggtgatgcttttttgcactctaaaatgaaagcggggcgttgatgtgtaccttggcttaacgcttgataaaaagagcggtcggatttttttattttctgttgaaattgtgcgagaggaaacgacgattgtttttctgcgatccattgttttttatcttgtacaattttttgcaaaatagaagggatattgtgttgcatgataattcctatttattgatacgtttttaattggtttaatgtttcaaatgcttcaccgttcgccataatatttaaggctttttctgcattggctttaagatcatcattgccaaataatttcattaataaggcaacattcatagcaacagcttgattatgctcatctttgccttttccttgtaaaagtgcggtcaatatttcggcattttcttctgccgtaccgccacgtaaggtttctaatggtttaggactaaagccaaagtcatgaggcgttaaactataatattcaatttttccatgacgaatttccgcaacatcggtttttccatgaatagcaacttcatctaaaccggaaccatgaataacgatactatgttgatgctctagtcttaatgcactctcagcataggttttaagtaagtgcggtgtataaacccccagtagttgatgttttggacgagcgggattgcataaaggacctaaaatattgaaaatcgtgcgtgtttttaatatttgtcgtacaggtgcgacatgtttaaatcctgaatgatattgttgagcccaaagaaaacaaaggttgagattatctagagcttgtttggacttttcggcagataagtcaatttttacccctaaagcattcaatacatcacttgcaccgcttttaccggatacacttcgatttccatgttttgccactttgtatcctaatgttgcagcaacaattgccgcagtagttgaaatattgatggtattagcattatcacctcccgttccgacaatatcggcaaaagggtagtctatgaatggaaatggcttagcgttggcaataatggcttttactgcaccgctaatttcatctgcttgttcaccacgaaattttaaagcgataagtactcctgcaagttgttcattagaaagttgtccttgaataatataatgaaataactgttgtatttgttcttggtttaaatgttgtccgtcgaaaagttgactgattaattgttctgtttgcatgttgttttccttcttatttttcgttctatgttgacgtcggtaaatcataaataattatattgttctctactttgagccaataaccattgaatactttgctctaataactgtgagccttgcttcgttaatatactttcagggtgaaattgaaaactgcaaataggcaaggttttatggcggatagccataatgattcccttatattcagcattaataataaactcttccgaaatttttcttcccattaaagaatgataacgagcaactggcataggattatctaacccctgaaacatcatttggttatcatgataaatatttgatactttcccatgtgaaatttcaccggagggaacaacttctccaccgaatgcttcaatcaaagcctgatgccctaaacaaatgccaatcatagctactttaccttttagtgtttgaattaaaggcaataaaattcccgcctgtgcaggagtacctggccctggtgagagggctaaaacagtctctttttctgctaaaataatttgagttaataactttaaatcgaagttattgcaaaaaacttgtacttgatgccctaaactgcggaattgatctactagattgtaagtaaaggaatcaaagttatctaaaaatataattcttgccatattgtctccttagtcttgagtattggtttgcaatattgcattaatcacagctttagctttgtgacgggtttcatcagcctccatttgcggatcggaatctaagacttcaccacaacctgcttgaatataagcaataccttgttgtacaaaagcggaacgtatcacaatacaggtatcaaaattaccatcagaagataaatatcctattgcaccgccataactatgacgcttttgtttttcaacttggtaaattaattgcattgctttaattttcggggcaccagttaaagtccccatattcatacaagcctgataagcatgaaaggcatcaagctcggggcgtaattttccgactacacgagaaacaaggtgcataatatgagaatagcgatctacttgcattagctccttaacctgtcttgtaccgctttcacagactcgagcaatatcgttacgagcaagatcaacgagcataagatgttctgcgagttctttcttgtctaaacgcaattccaactccaaacgagtatctaattcaggatcgatattaccctgttgatcaaagccacgagaacgagatccagcaatcggataaatttctacttggcgattttcagcattatatttcaatgcactttcaggagaggaaccaaataagatgaaatcggtatcttgcataaaaaacatataaggacttgggttatttttctttaattgacggtagctggccaacgtatttgggcattccagcataaagcgacgagaaggaacaatttggaaaatatttcctgcataaatatgctgttttaattgttcaataatggctttaaaagattcgtcttctaaatttacttgtactgcaacactcgcttttgagacagctaagtgcggttcaattttcgttaatttttgacaaatttccatcgcacttttttgcacattacctaattcttgcgaatgaaaacagaatgattgtagagtagtttgttgtaattgatgatcaatcaccaataaattttctgccaaataaaatacatagtcaggacaggttaatccatcatcttctaggctaatattttccattggtataaaattaattactaaatcataggcaaataatccccctagaaaaatgggtattttggattgagcataaatatctgttaaacaacgtaacccatcaaaaacggttgttgcctgtaatttgctatcttcatcgagattgggattaatcggagggataataacttctaaatcgctttcagacttcacaagtatttttgctgttggctgtaatttttctttaataagaggtaaaactgtttttccattgctggttaaagcgttaaatataatagtattaccgaaacaagatattttgattgcggaatttacaaacaataggctttttaaactatttttactggagatttccgcactttctaacaacaaagtattagttttttgttgacaaagtgttgcaaaaactgcggtaggatctttgtgataaggtaacttctgagttaatacttcaataaagggggtaaacataaaagaatccttatttagaataaatttaaatatgaactattaaactagtacagatttgttttgtcaatggtgaagtaacattattttaaaagtaagtatttgaaataaaaaaattgcaattttcttgcgagaaagcataagcaataaaattgcacttttaaataaattcgttatgataatcggttcataatttcacttatataaggaagaaaaaatgtggtctgagttattgattggttatggcttgtttattttagaaatactcacaattttattaattgttgcagggatagtgatgatgattatgacactgaaagaacgtaaatcacatcaagtcggagagttggttattacagatttatcacgagaatatgaaaataacagtaaaaaattgcgtgatttttacctgagtgacgatgcgttaaaacaacgtgaaaaagagcagaaaaaagccgataaacttaaagcaaaagaagaaaaagcccaacgtaaaaaaggggaaacgttagcagaaaaaagaaaaccacacctttttgtattgcattttaaaggtgatatttctgcttcagaaaccaccgcacttcgagaagaaattagtgcgattattgcggttgcaaaagaagatgacgaggttttattacgcttagaaagtcccggtggagttgtgcatggctatggattggctgcttctcaattagctcgtttaaaacaacgcaatattaagctaactgtagcagtggacaaagttgctgcaagcggggggtatatgatggcttgtgttgcagataaaattatttccgctccttttgccatcattggatctattggtgttgttgctcaaattcccaatattcatcgcttattaaaaaaacatgatatagacgttgatgtaatgattgctggtgaatataaacgcacaatgaccattttgggtgaaaatacagaaaaaggaaaagcaaaatttcaacaagatctagaagacactcatttattgtttaaacaattcgttacacaaaacagaccgcacttggatattgataaaattgcaacaggtgaacattggttcggcaaacaagcattagcgttacatttagttgatgaaattgcgacaagtgatgatttattgttacaagcaatcaaagataaaacagtgctttcggtaaaatatatgatgaaaaaatcactcattcaaaaattaggcaaacaagcagaagaaagtgctaataatgtgttgttacgattgctgaaacgtgatgagagtactttgatataagcttactcaacattgcccaaaaagagattaaaatttggtttacatttttgttgtttgatattaatatctcaagcagtgctgacgtgatttaatgcgacaatatttttgtaaagatagaaaattaaatcgtaagctattcaaaaaatttgaagaaatttatatacataaaattaaggtaaaataatgaaactatcacgttttgtattatctgctgttgtagcagcaacattgtcggcttgtggtaatttaagtaatgtcaccgaagagggtacatcagataacttaaagtggcctaaaattgatcagtcaagatttaatcatgatggtagccaatttggatcgtggccaaactgggataacctacgtatggttgaacgtggaatgaataaagatcaactgtataacctattgggacgtccgcatttttcggaaggtttatatggtgttcgtgagtgggactatgcttttaattatcgtgagaatggcgagcataaaatttgccaatacaaaattctattcgataaaaatatgaatgcccaaaatttctattggtttccaaatggttgtaacggttatgcatcttttagtttaaatacggatctcttatttgattttgatcaagatacgttgacctcaaaaggtgaagaagctgttgataatgttgcaatgcaattagaagcgttttcagccaaagaaattaaaattgttggttttactgatcgattgggtacagattcttataacttggatctttctcaacgccgagctgatcgtgttaaagagcgtttaattgaaaaagggttaaatattgatattatcgctattggatatggtaaaacgcaacagattaaggcttgcaatgatgtacctgccaaagaactaaaagattgcttacgtccaaaccgtcgtgttgaaatttcagcatacggaaacatctcaaaaaaatatggtaatggtgagctgaaggggggaacaaccggtccatcattatattacgaaaaataatctctcttgatataggtaagggcatcaaacgatgccctttatttatagaattatttatcacttttgtgcaaaatttgattaatcaatttctgagtgagagaaacataactttgctttttattataatagcgatagctgaaattgagcagataatagagctgataaataagttttctttctaagtaaccttcttccagtggatatatttcattatagcgttgataaaaattagttgggaaaggctcaaaaagtgatgaaaaagcaatatcgcattctctatctccccaatagcaagcaggattgcagacaaaaattttatcatctacttgaatacagttttcaatccataaattgccatgcagtatagagggtttggggttatgtttgctcaaagtatctgcaacaatttgcacgataagatctatatttccaaatatcaaacctttttctttacatacttgcaattgccagccaatacgattttcgctgaaaaatttagcccaacttgtctgccaatcatttggttgataaataggacctaaccaagtatcaaaatctaatccatacttatcaggcccttgtatttgatgtagctgtgctattttttcagcgaatattgtaaaagaagactgtttattctttgacttatttaacgcttctaacagtaaaaaactatgcccttgtgaattgccaattccataaactaaagggatattaattgaattagttttagctaaaagagctaactggtctgcttctgcacgaaacatagagcggtaggatctttcgtttattttaacaaaaacagtttgaacctcatcattaatcagccaaatttcattcatttcacctgaatataatttttctttatgtttaataaaatagtaggcaccaaattgttctgccagtacctgagaaatagatttccacatagctcctccgatatgattcaagttagcctgactagatgataatctgaataccggtaatattctgtgataaatatcaagttttaataaatatcttattaagtagtgaatttatgtaactcttatctatttatatctttactcatatgttatgtggattgaatatttcagcgaaatgataaggatataccaattagtctagttgttactaatacagtaaaatagatacgttttctaagagttttctgttaaaatgcaccgcacttttattgtacaaggtaggtataaataaaagtgcggtgctttcagcacttttttattttatgtttaactcaatttacaagtaacctttcgtatgggctaccactgtataaggattcacaatgccaattattactttacctgacggttcacaacgtcaattcgataatcccgtttctgtattggaagttgctcaatcaatcggttccggactcgctaaggctactattgccggtcgtgtgaacggcgagcgtcgagatgcctcagatatgattagtgaggatgccaatcttgaaattattaccgcaaaagatgaagacggtttagagattatccgacactcaacggcacatttattagggcatgctatcaagcaacttttcccaaatgtgaagatggctatcggcccaactattgacaatggtttttattacgacattgatttggaccgctctttaacccaagaagatattgataccctagaaaaacgtatgctggagctggcaaaaacgaattatgacgtgataaaaaaacgtgtcagttggcaagaagcaagagatacttttgaaagtcgtgctgagccttacaaaatagctatcttagatgaaaatattgcaaaatacgaccaacctgcactttatcatcacgaagaatatattgatatgtgtcgtggtccgcacgtacccaatatgcgtttctgtcaccattttaaattaatgaaagtagctggtgcatattggcgtggaaatagtgataataaaatgctccaacgcatttatggtacggcttgggcagataaaaaacaattagccgattatttacatcgattagaagaagctgcaaaacgtgatcatcgtaaaatcggtaaggcgttggatttataccatatgcaagaggaagcacccggtatggtattttggcataatgacggttggacaatcttccgtgagctggaaacatttgtgcgtacaaagttaaaagaatacgattatcaagaagtaaaaggtccatttatgatggatcgagtgctttgggaacgtacaggacactggcaaaattatgctgatttaatgtttactacacaatctgaaaatagagaatatgccattaagccaatgaattgtcctggacatgttcaaattttcaatcaaggcttgaaatcttatcgtgatttacctattcgtatggctgaatttggttcttgccatcgtaatgaaccatcaggatctttacatggattaatgcgtgtgcgtggttttacacaggatgatgcacatattttctgtaccgaagatcaaattgaatcggaagtaacgagctgtattaaaatggtttatgacatttatagtacgtttggctttaccgatatttttgtcaaactttctactcgtcctgaaaaacgcattggtgaagatgctatgtgggatcgtgcagagcaaggtttggcaaatgcacttaaacacaatggtcttgaatatgaaattcaagagggggaaggggcattttatggaccgaaaattgaatttgcattaagagattgtttagatcgtgaatggcaatgcggtacaatccaattagattttgcgttaccaggacgtctagatgccacctatgttgcagaagataatgcccgtcgcacacctgtcatgatacatcgtgctatcttaggttcaattgaacgttttatcggtattatcactgaagaatatgcaggttttttccctacgtggttagcaccgattcaagctgttgtgatgaatattactgatagtcaagcggattatgtgcaaaaagtagttaagcaattttctgaagcgggattacgtgtaaaagcggatatacgcaatgaaaaagtcggtttcaaaattcgtgaacataccttacgtcgagtaccttatatgctagtttgcggcgataaagaaattgtggaaaacaagatcgcagttcgtacccgtaaagggacggatttaggcacgtttagtgttgaagaatttgttgagattttaaaacaacaagtaagaaaacgtgagttaaccttgttaggtgaataatgataaaaaatataatcggcacttaaaggtgccgattttttatggaattgttcatttaatacagtaatgaatacaacaaacgacgaaatttatttgtaatcggatcgttattaccaatggcagctaaaatcgctaaaaattgttgcttagcctctccatttaacgcattaagatcttgttttaatatatcaaacagcaaatttaatgaagcctcattacgattggcttgatgcaattgtaatgctagttttaatgcaatttctgctgttggatttttagcaaaatcagcttgcaattgctgaatttcaggggtatcagtcgcttttattaaaagctcaatttgagcaattaaaccatgccagcgactatcacgatcttgtagcggaattttatctaaaatctcttgggcgggttcaatgcgttttatcgtaatataggtttcagcgtagagtagagcaatatcgctatttttcttatcagataattcccatgcttctttgagcaacggtagagcgtcattatattgttcttgttccaacaaatttaatgcctgattaaatttcatttcttcttccttcggtaaaattagagataaacgttgttgtaacataatttcatctaaagaaccttggaaagcatctaatacttgtgcttgattaaataaataagttgttggtaatgattgaatatgaaattgtgcagcaatcattttttccgtttcacaattcactttacctaataaaaattgtccttgatatttttctgcataacgagtcaaaagtgcggtaaattctaaagagattttgttacttggggtataaaaaattaaaacaagaggtgtttgtacagaactttgtaatacacttgttagattttgctcattaatatcaataatatatgacataaaatttcctacgtttatttaaaggtaaagtgggtaaattgtaacaaaccaatcatttttttggaaaatatttcttcgatttaagactttcttaatattttttaataatacaaaacagctaataaagaattcggtcaggatgctaaaatagatgtaacagaagtgcagaaattaataaaaaccttggtattgtttgatatgagactgatttaaaacgtcattataaattctccaaaatttaatcgctaaaatagaagatctttgctagaatccgtacgaaaaacacctttctaatgtttttcattttggttattaattcatttggaaacacatataatggaaaatcaatcttttctacaaaaatacttcaagtttaacgaaaaaaagacgactacaaaaacagaaatcattgcgggaattaccacattttttactatggtttatatcgtttttgtcaatccgtcgattttaggtgatgcaggaatggataaacaggttgtctttgtaacgacttgtttaattgccggtttgggaacaattgcaatgggattatttagtaatttacctattgcacttgcaccagcgatgggattgaatgccttttttgcttacgtcgtggtaggaaaactagggtattcttgggaaattggtatggggacaattttctggggatcggtagggttacttttactaactgtctttcaaattcgctattggctgatggcatctattccgctgagtttgcgtgtcggtatcggagctgggataggattttttattgctttaatcggctttaaaaatatgggactggttgtatctaatccggtaacgttggtttcgcttggtgacttacatagctcgcaagttttaatgggggttttgggattttttattattgtagtgttggctgcacgtaatatttattctggagtcttggtttctattgttactattacggctttagcattgatttttgatgaaaatgtggtttttaacggcgttatttctatgcccccaagccttgatgctgtagtcggaaaagttgatgttttaggtgcattagataccgcacttttaggcattattttttcttttttgttagtaaatttatttgattcatccggaactttgcttggtgtaacagataaggctggttttagtgatgctcaaggtcgtttcccaaaaatgaagcaagcgttgtatgtagacagtattagtgctgtaacgggttcttatatcggtacatcggcaatcagcacttatattgaaagtggtgccggagtgtctgtcggaggtcgtaccggaatgaccgctgttgtagtcggaattttatttttacttactattttcttctctccattggctggtatggtgccggcttacgcaacagcaggggcattagtttatgtaggtattttgatggcatcaagcttaattcgagttgaatgggacgatttaactgaagcaacaccagcttttattactgcagcaatgatgccattcacctattcaatcactgaaggtattgcctttggttttattagctattgtgtcatgaagacttgtaccggtcgctggaaagagattaatgcaccggtttgggttgtatctttgctttttgtagcgaaatttgtttgggttggataaatcattaattattgaatagatctttctaaagcggacattagtccgctttcttgttgatttaactagaattttgggatttttatggaacataaattagaagatattatttacatttttaatcgatgctttgagcaagagtataatacaaggttagttaaaggtggtgatgaaccgatttatattccggctaataaagattgctcttataatgctatctatttcgcacgtggtttttatagtagtgctttgcatgagattgcacattggcttattgcaggaaaagagcggcgaaaattagaggattttggttattggtatgagcctgatgggcgttcaatggaaaaacagcgtgaatttgagcaagcagaggtaaaacctcaggcattggaatggattttagcaactgcggcgggatttcgctattttgcgagtagcgataatttaaacggtaatccgggagatacacaaccttttaaattagctgtttatgagcaagttaaaacttatgcacaaaaggggttaccgaaacgagcagaaactttgcgtaaagccttagcggaattttataaaacagaagaccgcattgttctgagtaaatttgacgtagcgaggatataaatgttagctctggaaattaaacatttgacaaaagaatataaaaatggggttaaagcactatccggaattgatcttagggtagaagagggagatttttatgcgttgttgggacataacggtgcaggaaaatcaacaaccattggcattatcagctctttaataaataaaaccagcggaacaataaaagtgtttggttatgatttggatcggcaattagctcaattaaaacggcatattggcttagtaccacaagaatttaactttaatcaatttgaaaaaattcaagacattctagtgaatcaagccggctattatggtattgagcgaaaagaagcacttaagagatctgaaatatggctaaaaaaattagatttatgggaaaagaaagatcaacaagctatgcgtttatcaggtggtatgaaacgtcgcttgatgattgctcgagcattaatgcacaatcctaaattattaattttagatgagcctaccgccggtgttgatattgaactgcgacgtgctatgtggacttttttaaaagaacttaatcaacaaggaacaacgattattttaaccacacattacttagaggaagctgaaaatttatgccgtcatattggcattattcagcaaggtaaactgattgttgatatgtcgataaaagccttattgtcacagttagagacagaaacttttattttagatttagcactttctagttcaacgccaaaggttgataattacaacgtcacaattattgatgagctaacaatggaagttgaagttaagcgtggacaaggactgaataatttatttattcaattaaatggtcaaggaattaatgtattgagcatgcggaataaagccaatcgcttagaggagctgttcatttctatggcgttaaataaaccaaaaatcacggagaaaatataatgttagcttggattgcgtttaaaacaattttaactaaagaaattcgtcgttttactcgtatttgggtacaaactttagtcccaccggtcattacaatgacactttattttattatttttggtcatttgattggagcaagaattggagaaatgaacggctttagctacatgcagtttattgtaccgggattaatcatgatgtctgcgttgactaattcttttgctaatgtggcgtcttcattttacagtaccaaatttgctaaaaatatagaagaattactcatttcacctacttcttctcatattattattttaggatatatggctggtggtatagctagaggtttatgcgttggtattttagtaacaatcgttgctatgttttttgtggaaatgactgtctattcatggctaattattgtgttgacacttttaatgacaacagcaacctttgctttaggtggtttaattaatgctgtttttgcccgctcttttgatgatattagtattattccaactttcgttttaacgcctttaacttatcttggcggtgttttctattctatttctttgttacccgctttttggcaaaacatatctaaactgaatcctattgtttatatgattaatgggtttagatatggttttttgggggttagtgacgttggaattcattatactttcactgttctgacattatttattaccgcactttatggcttggcatactatctaattagtcgtggggtagggttaagaaattagccgtcagatcaatacaaacaaaggcgaataatcaatactcgccttacttttatgaacctaagttttttcctttaataaacaaataaatttgcaattgtttatatttgatctatttaggtagttttccttggttttctatttcatagcaaggttcataagcatcacctccaggtaatttcattctgtgctggttgatgaaatcttgcaataaattgtcgactttttccattaatacgggatcaccttttagtttgaattttcctaattctgtaattttatcttgagtatctggtttgatatttcccgctacaattcctgagaaaactcggcgtaaattagcagctaaatcaactttagattggtcaaaatgtaaagctaaatttgccatgttttcatgagttgggataaacggtttttgaaattcagcagtaatttctaatgaccagttgaaataatacgactcatttttttcataacgtgatttttggatgtcgcgcatagcattatttatatggcgagcaactgaaaccggatcatcaatgataattttatataaagattgtgcttcagatcccaatgtatcaccaataaattgatcaatagaagcaaagtaagccgcactttcttttggaccggttaagataagcggaagatgttgggcatwrttatttggattgagtttaatgcctaaaatataaaggaattcttcaaaagttccaggaccgccggggaaaataataatcccatgtcccatacgcacaaatgcttctagacgtttttcaatatcaggcataataataagttcgttcacaattggatttggaggctcggaagcaataatagatggttctgtaataccaataaaacgactttgtttatagcgttgatttgcatgaccaatggttgcacctttcatgggtgcttccattacacccgctccacagcccgtgataatattcaactcacgatgtccaagttctaaacctacagaacggcaatattgatactctatttggttaattgaatgccctccccagcaaacgactaaatttggttgctcaccgttaattagggccttagcattgcgtaaaatggcgaagacttggttagtgatatgtttactatcttgaatatcacaagggttaatgcgttgatttaatacattaacaaataaaatatcacgtaacacagcgaataaatgatattgaatatttttaatcattttattatcaacaaaagcattttctggtggattatgcaattctaaggcaatgccacgttcttttgctaccaagttaatatcaaaatcaggatatttacttaatagctcacgactgtcatctgtaattgcacccgagtttaatacggctaacgaacaattacgataaagttgataaagtttacttttagcttttttagctagttgttcaacttccatgtgtgaaagttgatccatgcttcctttgggattaacataatgtatatttttcataaaagttcctttttattggcgtgcaagacgctggttaagtggaataggctcaaaattggaacgaaatggattaatatccaatccgcctcttcgtgtatatcgagcataaacactcagtttttcaggttgtgcaaatttcatcagatcacagaaaatacgctctacacattgttcatgaaattcattgtgttgtcgaaaggaaataagataacgcaagagtttttctctgtttatttggttaccaatataatgaatttgcacagttccccaatccggttgattggtaattaggcaatttgatttcagcaaatggctgactaatttttcttcgacccattgcttgttggtgcaattttctaataaatttggatcaaattcatagcatcgtatttcaatatcttgttcatcaatacattcaccttgtagagtagcgatgagttgttgagcataattctgtaacgaatttaaccgcacttttacttgcccttttgcacattttattaaatcttgttgcagtatttgttcaacctgttgtagattttcaaactgactttgattaaaactatttaaataaagtttaaaactttttgattcaatcagattttcactttgataatcaatttcaacatcagcaatagcaacttgaggaacaccttttaaatttagccaagaaatttcataggccgtccaaatatccgcaccgaagctaaagggctgttttgtactaatacctaaatcatctcggttaagtttgcgtggtaccgcttgtaataaagtgtggtcgtaagtagagatatattctgttttttttcctaattttaatgtttgtaaactttggtcatggtattgcatgattcatcctttttgttattgccaatgccaagataaattggaaactaggcgacaatgatcacatttaaaatgaaagagattaaataacggtttatctaaatgccatttttgctgacaattaggacataagcgttgttgttcactttgcagatcatcaccgccaatgcgataaagataataaaaagtgggaataccggtatgtttttcaatttcttgagtcagataatagccgtgtttagttaaatgactattgaaatcactgatttcatacagtgcttgttgctctaaaattgaaccgttcatttgcaattgatcacaagcctgccaattttcttgccatttaataatatccatactcaagtgcggtatgtttttaaattgtttatataatggaatgggcaataaattatcaccgctatgtagcggagaacaagactgcaagtacgttgtatacaacacttgccaagtcgctacctcttttgagtaagttatatctgaatttaaatcatccgcaatgatttgaaaactatcaaaaaaaatccccgcactttttgcttgttcaagggctttatctacttgtatgttattgaatgtaggtaacaaactttgctgttctggacaagttactcgcaatgcaaatccctcttcattattttgaactgcaacaaataatggaatttcacgtccaataatttgtccgttataacgccattgctcaataatttgattaattagataagaaatattactaattggcaatttttgaggttgtcgataggtaaaaaatacttcaactagatacatatttattgtttgatgattattcgaaagggtagattaacataattaatttgcatagaataccgctttttattttggaatataacgcatgaaaattgaaatcaaaacgcacttacaagcgttacaaaaaattatgcaggacttagaattatggcaatcctttccgcccgatgaacaggctttttcaagcaccgcccctttttctatggatactatgagtgctaatgaatggttacagtgggtttttatccctcgtatgtatgcattgctggagggtcaacaatctttaccgtataaaatggcaattacaccttatatcgaagaagcattaaaagatcttgatggattaaatgacctactacagcctattcatgaaattgagaaattatgtcagagccaatagaattggatattttatatcaagatgagtttctcgttgtagtgaataaacctgccggaatgttggttcaccgcagttggctagatcgtcatgaaactcaatttgtcatgcaaactttacgagatcaaattagtcaacatgtttttcctattcatcgtttagatcgtccaacatcaggtgttttactttttgccttaaatgctggaattgctaatttattatgttcacaatttgaattaaaacaagtgaaaaaaagctatttggcgatagttcgtggttatttgagcgatgctcaacgaattgattatccgcttaaagtgcaactggacaaaattgcagataaatttagtcgaaaagaagaactgcaagatgcaataacggattattatggtttaaaaaccgttgaaatgccttatggcgtagggcgttatagctcttcccgctattcacttgtacgtttaatgccttatacgggacgtaagcatcaattacgtcgccatttaaagcatatttttcatcctattttgggtgatactcaatatggtgatttacaccaaaatcgggctttcagtcaaaatcttggtgtaagcaggttaatgttacatgctgaaaaactttgttttcaacatccggtaactaatgaaacaatagaaattgttgctgatttagatgagcaatggaaattgttattcaaaatatttaattggtaaatagctcagaacatttgaggaagtatatgttaaataatgtaaaattaactcatgaagaacagcaaagtgcggtagaaaaaattcaagaattaatgcgacaaggtatgagtagtggggaggctatagccttagttgcgaaggtgttacgtgaaaaaaagttacaccctgaatcaaaatataatgaaattttgtgatctctgtcggatttttgaatattatttattgcaaatatagttaatttcgttgagtatttagttaaattttaggaaggtggtaaggctcacagtcttattatgaagtatagaggtctgtaaaggcttaaaaccaaagaggttaaaatattatggaagtaggtattgttaagtggtttaataatgcaaaaggatttggattcctgtctgttgaaagtagtgatgttgatgtttttgcacattattcagtcattgaaatggaaggatatcgttctttaaaggcgggacagaaagtacaatgtgaagtcgtgcatggagataaaggttctcatgccacaaaaattatccccatggttgaataataaaatcaaagctttttgtttcggtgtattgagcaaggttttaaccttgcttttttatgtgataaaactcgctattttagcagatctttaagaccttctttcataacggaaacttgattttcatataagaccttgctttctctttcatcaatcatataagaaatagtttccgataaagtcattttcattttacgtgaataacgagataatcgaagccagaccgcatattctagatcaattgattttttctttgtagattgtttctcgccattgaaaaaacgttttcttcttgctcttatagcttgatccaacttaataactaaatttgatgacaaatgattttctatccaatcttcaattttttcagggtagttttggtgtgtcattaattgccgaacaatgtcttcttgtaaactttgttctgtataacgtgtaatattttcaccctcgcgtgattttttgatcaaatagatccatttccaatttgcttcttgatttgtcagcttctgatatttcattttgtttactcatctgtgacattgtaacctatgtaataatatacgctttttatattattttctagtaaattttaatcaagaatacagaagtgaattaaatagaaatatgcgataatatgaccttaatcgtttaatttgatagagagtacatgtgacaattgagcaaaaaataaaaaaaagagccgacgaatgcttgtcagaacagttaatttcttggcaaaatttattacccatgttacaacttgataatgattttttagacgcttcattatctgagattgatttttttactttgcaaccaagagctaaaagtgcggttgatcttttcctaaaaaatcctcaacgatcattgcttgttttaaaagcagatgatcaagctgaatatgcaactttactacaagaatatatagagcaaaaacttcctgtttctgaaacaattagtggtgttcagtatattattgaacagggagacagtttttcttttccacaaatcagtctagcacaggcagcatcaatggaagacaactttgcaggaaaacaaaaagtggcaagtgctttatttttcgatcaaagtcagttattcggatcagttgtaattcaccccagttctcatgatattcaacttaattcaggattagtacatcaagtaaataatggtgtattgattttgagtgccggtgcattgttggagcaatttgagatatggcatcgtttaaaacacttattactaacaggtattttcagttggtattctcttaatcctttgaaaacattaccttgcacaattcctaattatcccttaaatctaaaagttatcattttaggtaatcgttcagagttggcaactctaggtgaattggaggaggaactgtatcatttcgcagattatgcagaaattgaaagttatttttcgcttaatgatgcacaggctcatcaaaagtgggcaagttatgttcatacgttggcaaaaaaacaaggaattgagctgagtattgaaggaataaatgcactttatcaactttttgtgagagaaagtgaagatcgttacttaattagtatctcaccattaaaattaaaagggatcttatttgaaacacaaattttaagtcaaagaaaacatttaagtgcggtagattttcaattattttttcaacaaaaagaacaacagtactgtttcttacgtgagcaggcgtataaaggcattttacaggagcaaatttttattgctacagatggggaaataataggacaaattaacggattatcagtcattgaatatcccggtacaccggtttcttttggcgagccttcaagaataagttgcattgttcaatttggtgatggtgaagtaattgatattgaaagaaaaagtgatctggcagggaatatccatggcaaaagcattatgattgcagaaacttgtcttgccggcattttagatcttccttctcaattacctttttcagcctcaattgcatttgagcaatcttatggtgatattgatggtgatagtgcgtctttggctgttttctgctcgttattaagtgcgttggctgatttaccgttaccacaaaatattgccgtaacaggtagtattgatcaatttggtttagtgcatgctgttggtggtgttaacgataaaattgaaggcttttttgaagtttgtcagcgtcgtagattaacgggaaagcaaggtgtaattataccaagtgcggtattaaatcaactcagtttatccggtaaagtaatcgaagctgttcaacaagaaaaattctttatttgggcagttgacgatatttttcagactactgaaatcctatttaagcgatatttagtaagcgaacaggatgctggattggaaaaaaatcttcccctcgtagatgtgattcgacaacgattagaagagagatctgaacaacagcataaaggtcgtttttggaactttttctttaatcgccattaaatgttaagaaacacgtgattttttaacaggttagtattattattaggggcattttcgtttaaacattggatttttaattatttagaggacaggtatgtataacctacaagaaattactgaagaagcacggaaagcaattgaggcactgcaagataagagcattgaaagcttggaggcaattcgtgtggaatattttggtaaaaagggacattttacacaattaatgcaagggttacgtgatgtgtcggcagaggaaagaccggcagttggtgcaaaaattaatgaagcgaaacagaaggttcaagcgatattaaatgcaaaaaaagtggaatgggaagaaatagcgttaaatgaaagattagcccaagaacgaattgatgttagtttgccgggaagaaaaatggaactgggagggttacatcctgtttcaattactattaaccgtgttgtacaatttttttcaaaactaggatttactgttgagataggtcctgagattgaaacggattattacaattttgatgcgttaaatattcctaaacatcatcccgccagagctgatcatgatacattttggtttgatgcagaacgtttgttacgtactcaaacttcaggagtacaaattcgtactatggaaaaaatgtgtcctccaattcgtattatggcaccgggcaaagtatatcgtaatgattatgatcaaacgcatacgccaatgtttcaccaaattgaattattgtatgttgataaaaaagctaattttactgaattaaaagggttgttgcatgatttcttgcgagctttctttgaagaagatttacaagtgcggtttcgtccatcttattttccatttacagaaccttcggcagaagtggatgtaatgggaaaaaatggtaaatggcttgaggtgttgggttgtggtatggttcacccgaatgtgttgcgtaatgtgggtattgatccaaatgagtattcagggtttgcagtcggtatgggagtagaacgtttaaccatgttacgctacaacgtcacagatttacgttcattttttgaaaatgacttacgttttttaaaacaatttaaataataagggcaaaaaatatgaaaaaattaatatcagtcgcgttggttatgttttccccttttacattcgctttttcacagggacaagttaaattgcctatgcaggaaaaacaaccggcagcagtcattcgtgtatttgataattcggttaaaccctataaaatcattgaaggaaagaaactatctcgtagcaaaccacgtcatctttgtttatatatacttaatgtcgatcttcaggaaagaaatcttttagctcaatatgtacaagctcctgcaccgataaaggtaaatgtgccgaatgttaatgctaaagtacgaatggaagataaccagaagaattttttgattatgtttgacatgatgaaaaaagatattagaaataatacacctactctatgttgggcacttggtacagatgaccctatcggcatttacaaattggatgtgcaatttaataatgttgtgtttgaaaacttagaatttgaattattaaaatagagagagaattataaatgaagtttagtgaacaatgggtgcgtgaatgggtaaatcctgcaataagtactgaacagctatgtgaacaaattacaatgctgggcttagaagtagatgatatagcaaaagtcgcagcagatttttcaggggttgtcgttggtgaagttgtagagtgtgctaaacatccggatgcagacaaattacgggtaaccaaagttaatattggtggcgagcgtttattagatatagtatgtggggcaccgaattgtcgcaaaggattgaaagtcgcttgtgcaatagacggagctatattacctggtaattttaaaattaaaaaaactaaattacgtggtcagccatcggaaggaatgctatgctcctttaacgagcttggtattaatgaggattccagcggtattattgaattaccgcaaaatgcaccgataggtgttaatttacgtgaatatttaactctgaatgataacaatattgaaattagtctaacaccaaatcgtgctgattgtttaagtatagccggaattgctcgtgaaattggtgtagtcaataaacttgaactaaactcaccgcactttgaaccggtcaaagcaagtattaaagataaagtcactattgaagtattagcacctgaggcttgcccacgttatcttttacgtgtggtgaaaaatattaatgttaaagccgacacaccgatgtggttacaagaaaaattgcgtcgttgcggtattcgttcaatcgatcccgtggtggatataactaactatattttgttagaacttgggcaaccaatgcacgtatttgacatggcaaaagtgactcaacctgtacaggttcgtatggcaaagcagggggaggaattggttctattggacggttcaacagcaaaattgaaagaaaatacgctgataatcgcagatcaagaggggccgttagccatggcaggcatctttggcggacaggcaagtggtgttaatgcagaaactaaagatgttattttagaagcggcattttttgcaccattggctatttcaggacgtgcaagacaatacgggttacatacggattcttcgcatcgttttgaacgtggtgtggattttgaattggcacataaagcaatggaaagagcaaccgcacttttaattcaaatttgtggcggtgatgccggtgaaatttgtgaggctttaagtgaagcacatttaccaaaagtaaaacaaattcagctacgtcgtacgaaattagatacgttacttggccatcatattgaaacagaaaccgttactgatatattccaacgtttaggatttgcagtggaatatgcgaatgatgtctggacggttacttctgcaagctggcgttttgatattgaaattgaagaagatttaattgaagaggttgcccgtatttatggttacaatgtgattccaaataatgcacctttagcacatctacaaatgaaggaattaccagagaaattattagatctcaatcgtatccgtaccgcatttgtggacagcgactatcaagagattatttcttatagctttgttgatcctgacatacaaaaattgttacacccagaactagatgcacttgtattgccaaatccgatttcaaaagaaatgtcgacaatgcgattatcgttattgccgggcttgctgagtgcggttgtatataaccaaaatcggcaacaaaatcgaattcgtttgtttgaggcaggattacgttttgttcctgatactacagcagaatgcggtattcgccaagaatatgtgattgggggcgtgattgttggtgataaacgtcctgttcattgggaacaaaaaggtgaacatgttgatttctttgatttaaaaggtgatttagaacatattttgtctttaactcacgttggacatcgtttgcgtttcgtggctaaatcttatcctgcactacatcccggacaatcggcagaaattttacttgataacaaagaaattggttttatcggtgcagttcatccaaaaattgtacaaaaattggatttgtccggaaaaccgattgtattccaaattgaatggaatgcgatttctgagtgtgatgtccctactgcacaagaaatttctcgcttcccagccaataaacgtgatcttgccattgttgtagacgctgacgttgtggctggagaagtactggaagtttgtcgtgctgttggaggtaaacaacttattaatgtaaatttatttgatgtttatcagggggtaaatctacctgccgataagaaaagtttagcacttagcttaatgattcaagatacagagaagacccttgaagaaaaagatattaatgcggtaatatctgttgtattatctgcgttgcaacaaaattttaatgcttacttgagagattgattatggcactgactaaaattgaacttaaaaatagcttgattgaacagggtttaaataaattagaggcgaagaaagtagtagagggcttctttgaacaaattcgagtttcattagaaaatggtgaagatgttaagttatccggatttggtaattttgaattaagagataagtcatctcgtccggggcgtaatcctaaaacaggtgaagctattcctgtttctgctcgtcgtgtcgttgtattcagaccgggacagaaattacgttcaagagtggaaaaaaccaaacctaaaaattagggattttttgtttctttaagaaaagccgtttacattaagtaaatggcttttatattttaacgtaatagaaaaggtgtaatggacaaaatagttgctaaaaagtgcggtcagtattttatttttttacaccgcactttcttaccttaatttacctctttgaaactaatcatttcgccttgaataaaatctattttttcatcgttttcttgaacgaggggagtaggtgagaacgcttctttatcaaaagcaatatcaccttctattccttccggaatctttccatgtcggatacgtttaaaatcaaataagttagaatcacataaatgtgaaggcacaatattttgtatcgcactaaacatagtttcaatgcgtccaggatattgacgatcccatttttgcaacatttctttgacaacttgacgttgtagatttggttgagaaccacataaattacaaggaataattggaaattgtttggcaactgcatatttttcaatatctttttctttacagtaagccaaaggacgaataacaatctgtttgccatcatcactgatcagttttggcggcatagattttaatttgcccccataaaacatattcaaaaacaaagtttccagcatatcatcacgatgatgtcctaaagcaattttagttgcccccaattctgttgcggtgcggtataaaattcctcgacgtaaacgagaacagagagaacaagtggtttttccctcaggaattttttcttttacaataccatatgtattttctgccacaattttgtaatctacactaatgctttttaaatattcgggcaaaatatgttcaggaaagccaggttgtttttgatccaaattcactgccacaatatcaaaatgaataggtgcattgaggcgtaaatttaataaaatatctaacaaagtataactgtctttaccaccggataggcaaaccatcactttgtctccattttcaatcatattaaagtcagcaatagctttgcctacattgcgacgtaatcgcttttgtaatttattcaagttataactttgttttttatctttttcggtaatgatatttaaactcatacagtttctgatcttgttaagaatgcgatatagtaaaggggaattgccactttgccaacagaaaactgtgtttttaatgatctattatttaaattaagtacgagataaaagtgcggtagtttttagtcatatatctattagaaaaagcaaaattacgctataatcttgcacaattttgcgtaagttattgcattgtgagaattgttaatgctcgaaacatcacaaactattcctgaattagtcaactggacgagagaacgagagctttctttgagtctatctacagaacgcttggcgtttttgctggctattgctatttacaataatgaaagacttgacggtgaaatgttggaaactgatctcattgatatttttcgccatatttcaaacacgtttgaacaatctgctgaaactgttagtacaagagcgaataactccatcaatgaattagtgaaacaacgttttttaaatcgctttagtagtgagtttactgaagggttatctatttatcgcttaactcctttaggtgtaggggtatccgattactatattcgccagcgagaattttccgctttacgtttatctgttcagctttctattgtagcagatgaaattcaacgagcttcagaatctgcggaagaaggcggtgatgaacattattggcgtaaaaatgtatttgcaccattgaaatattctgtagcggaaatctttgatagcattgatttatctcaacgtatgatggatgaaaatcaacagcatatcaaagaggaaattgctgaactgcttactaaagattggcaaacggctattgccagttgtgaacgtttattagatgaaacctcggggaatttacgtgaattgcaagatacgctcaatgctgccggcgataaattacagtctcaattgttacgtattcaagactgtgtaatagggcatgacaatttgtattttgttgagcaacttattgtagatttacaagcgaaactcgaccgtattataagctgggggcaacaagctattgatttatggattggttacgatcgccatgtacataaatttatccgtacagccattgatttggataaaaatcgtgtcttttcacagcgtttacgtcagtctattcatcattattttgatcatccttggttcctttggatcgcacaggctgaacgcttaattgatctgagggaagaagaattaacactacgtgaagaagaagcccttggggaactgcctgaagaattgcaatatgaatcccttgctgatttacatgagcaaattgtggaaacaatgcaatctttattaattgaatatcgtctacaaaatacccctattgatttgagtgaggttttgaccgctcaactaaaacaatacccacttgctaaacattttgatatagctcgtattattattgatcaggccgttcgtttaggtttagctcaagatgatttaaacggtatttatcctaattggagatcgattaacgaaaatggtgcagaagtacaggctcatgtaattgataaatattaacccaatttaaccgcactttttgtaactgattaatttaacaactttctgaaaagaaaagagaaaaatatgacagataatattcaagatttactttccattaaattagctagagctattgcaaatcctttattccctgaagtggatagccaattgcgttcaggtaagcacattggacaagagtatttagataattattcatttttggcagattttcaacatgaattagatagtttctaccggcgttataatgtggaattgattcgtgctccggaaggatttttctacttacgtccaaaagcaaccacgttaattgctcgctcagtgttgagtgaattggaaatgttagttggaaaagtgctttgttacttgtatctcagtccggaacgtttggcacaacaagggatttttactgttcaagaagttcatgatgaattgatcaacttggctgatgaaactaagttattgaaagcaattaatttgcgtgcaggtggttctgatttggataaacaaaaattagcggaaaaagttcgttcagctatcagtcgtttacgccgtttaggtatgattcatgcggtaggcgatcaacatagtggtaaatttacgatttctgaatctgtgtttcgtttcggtgcagaagttcgttcaggggacgatccgcttgaggctcaattacgtttaattcgagaaggggaagcggcaacggctcaatcattacaagaagaaaaaaatggcttgaaagataatatggatcaaagtgcggtagaaaatgaacaatattttgaaaatgaagaaaatgaggggattgcataatggtagatttagcgttacagccgaccatgtctgaagaaaacatcgatcaagttgaactacaggataaacaagaatccctcgaaaattttacggcattttcgccttttcgttctcaggggggagtggagcgaggtaagtttcgttctttaaccttaattaactggaatggtttttttgcccgcacttttgatttagatgaattagtaactacgctttcaggcggtaatggtgcaggtaaatctacaacgatggcaggatttgtaactgcacttattccggatttaactttattacatttccgtaacaccactgaagccggtgcaacaagcggttctcgtgataaagggttacatggaaaacttcgccccggagtttgctatgcggttttagatactattaattcacgtcatcaaagaactttagtgggagcaagattacaacaagtggcaggtcgtgataaaaaagtagatattaaaaccttttctgttcaaggcttagcattatcacaaaatccaaccgcacttttcactcaaataattgatgagcgtcaagcgaggatattaaatcttaatgaattaaaagacaaagttgaaaaactcaatgctcaattcaaacaatatcattcaataacagattatcatgcgatgatgtttgatttggggattatcccgaaacgtctgcgttcttcttcagatcgcagtaagttctacaaattaattgaagcatctttgtacgggggtatttcaagtgccattacccgatcattgcgtgattatttattgcctgaaaatttgggggttcgtaaggcttttcaggatatggaatcagctttacgtgaaaaccgtatgaccctagaagccattaagattactcaatctgatcgtgatttatttaagcatttaattactgaaacgactaattatgtagcatcggattatatgcgtaatgtcaatgagcgtttaggtaatattcaacgtgcgattaattttcgtcgagattggtataaagcaaaaggtgagcaatatttatcacaacatcgcttagtggaattgagtaaagaagctgctgatttggctgaaaatgagaaaatcttagaaatagatcatcaaagtgcggtagatcatttgaatttagttctaaatgctttacgtcatcaggaaaaaattgaacgttatcaacaagatgtgcttgaaatcacagaacgtttagatgagcaaactttagtcgtggaaaatgcgaatgagcaggtaattgacactgaagtacagttacagaatgtagaaagtgaattggatcagattcgtaatcaattagcggattataagcaagccttagatgcacaacaaactcgtaatttacaatatcaacaagccatacaagcattagaaaaagctaaacatttatgtggattacctgatttagctgttaaaaatattgacgattatcaccaagagtttgcggttcaagctgatcaattaactgagaatgtactggatcttgagcaaaaaatgtctttgacgcaagttgcaaaaacacaatttgataaagcttatcaattggtatgtaaaattgccggcgaagtacctcgttcagcagcatttgagcaagctaaggaattgttgagagagtatccgacacaaaaaatacaagctcaacaagtctctcaattaagtgctaaattacatgagcttgagcaacgttatcaacagcaacaaagtgcggtacgtttattaaaagaactgaatcagcgtgcggatttacaggtcgatgaagcagaacagttggaagattattatgtagaacaagaagcattgattgaagatttaaccgacaaattatcagagcaaatagaaaaccgctctgtcttgcgtcaaaaaagggagcaactaactgcacttcatcaagaaaatagccaaaaagcaccggcatggttaacagcccaagccgcattggagcgtttacaagaacaaagtggcgaacattttgcagatagtcaagatgtcatgaatttcatgcaagcacagttgattaaagaacgcaacttgacgattgaacgtgatcaacttgagcaaaaacgtcagcagttagacattcagatttctcgtttaagtcagccggacggctcagaggatgctcgtttaaatatgctggcggaacgtttcggaggtgtgctgttatctgaattatatgatgatgtacctattgaagatgcaccttatttttctgcgttatatggaccggctcgccacgccattgtagtacgagatataagtgcggtgaaatctcagctggataatttggaagattgccctgaagacttgtatttaattgaaggcgatccaaccgcatttgatgacaatgtattggattcaaaagaattggctcatggggtagttgtacagatttcagatcgtgagttacggtattcgaaattccctgaagttcctttatttggtcgagcggctcgagaaaaacgtttagaagaattaaatattgaacgtgatgaaatttcggaactttatgcacaaagagcttttgatgtacaaaaatgtcaacgtttgcatcagcattttagccagtttgtcgggttgcatttggctttagcatttttacctaatccggaacaaactattgctgaaattaatcagcaacgcaatgaagtagatcgtgaattaaatctacttaacagtacagaacaacaattgcgtcttcaattggatcaagccaaagaaaagtggcaattacttaacaaattaagaccgcactttgctctattggctgaggacagtttaatagatcgtattgaagaatgtcgtgagcaactggattttgcacaacaagatgagttgtttattcgtcagcatggtgcgaatttatcgcaacttgaacctattgtaagtagtttacaaagcgatcctgaacattatgatcgtttaaaagttgattatgacgaagcagttattttgcaaaaaaaagtacagcaatgtttgtttgctttatctgatgtaatgcagcgtaaagctcattttgcctatcaaaatgaagttcaaaccgaaacttctgatttgaatgagaaacttcgtcaacgtttagagcaaacgcaacaacagcgtaatgatttccgtgaaaaattacgtcaaaagcaagaacaatttgcccaatataataaagttttaattgagctgacatcttctttgcataataaacaacaagtactaaatgagttgttacaagaagtaggtgatcttggtgttagagtagttcaaggggcagagcagttggctcaatctcgtcgagatgagttatatcaacaactttctatcactcgccaacgtcgcactcatgtcgagaaagaattaactcgaattgaaagcgaatcgcaaagcttgcatacccgtattcgcaaagcggaacgagaatataaggctcaacgtgaaacagtagtagcggcgaaaattagctggtgtgtggtgatgagattatctcgtggcagtgatgtcgaaaaacgtctaaatcgccgtgagtttgcttatttatctgccaatgaattgcgttctatgtcagataaagcccttggtgcattacgtcaagctgtagcggataatgaatatttgcgtgattcattgcgaatttccgaagatagccgtaaacctgaaaataaagtgcggttctttattgcagtttatcaacatttgcgtgaacgtattcgccaagatattcttaaaacggacgatcctattgatgctattgagcaaatggaaattgaacttaaccgtttaactaacgaactgactcaacgagaacaaaaattagcgattagttcagaaagtgtggcaaatattatgcgtaagacaattcaacgtgaacaaaatcgtattcgtatgctaaatcaaggtctgcaaaatattgcttttggacaagtcaaatctgtgcgtttagtagtgaatattcgtgattctcatgctatgttgctcaatgccttatctaatgaacagaccgaatatcaagaactctttacggatactcgcataaccttctctgaggctattgctaagttatatcaacgccttaatcctcatattgatatagggcaacgtaccgcacaaacgattggtgaagaacttttagattatcgcaattaccttgatttagaagtagaagtctatcgtggtgcggatggctggttgcgtgcagaaagcggtgctttatctaccggtgaagctattggtacgggtatgtcaattctcttaatggttgtacaaagctgggaagaagaaagtcgccgtattcgaggaaaagatattattccttgccgtttgttattcctagatgaagcagctcgtttagatggtaaatccatctcaacgttatttgaattgtgtgagcgtttagatatgcaacttctcattgcagcacctgaaaatattagtccggaaaaaggcacaacttacaaattggtgcgtaaaatttcaggcaatcaagaacatgttcatgttgtcggattgcgtggatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgaatataaaagaaatcaaaatattagtcttgttgatcagggaatttcttatcttaatttaatgcttgataataaaggtgagtttattcttgaatataatgaaaaaaatgaaacaaaatcattaaaaagaaatgaagtagattggtctcagtcaaaaattatttttgtgtccccatcatttactgatttccaaattcaagctacgaattttaaggatttgcctattgagttatgggaaataaatcaattcaatcaagatattataactatcaaacagattaaaaaatccaaatctgcacctagcgtaaaacagattaaggttacccaagattcatctttagataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcattatctgattcttgccgttttatgtagtgtttccgtttccgttttatttaaatacaccaaaaaatatcaaattgtaaccgcacaaatgattgcatttggttatgtggttgccttgtcattgagctattttttattagcacctaattttaagggacttacttttaccgaattttttgcacaaagtgaagctaagccgatctttatcagtttagggattttattgcctgtcggttttttagtgatgtcgaaagcagtggagtatggcggtattattcgcacagatgctgcacaacgtttggcattgttcttgcaaattatcgctgcagttgtgattttcggtgaaaccttaagcgatatgcgaattgtcggtatcattgtcgcatttttcgctttatttttcctattaagcaaacctgccggagggataaaaagtgcggtcaaagccgcttttgctcttgccggcgtttggttaatttggggagcaacagggattttatttaagaaaattgcactaatgggcggtgcatttcctacaaccttgtttatcacttttgtcctagccggtgtgattatgtttatctacctattaatcaaacgcactaattggacagtatccagcctgattggtggcattattttaggttgtttgaatttcggtaatatcctgttttatatctacgcacatcaacatttcaaagaaaatccaaccattgtttttgccacaatggatctcggcgtaatctgtcttggtacactagtcggtgcaactatatttaaagaaaaaatcagcaaattcaatggtattgggatcttattaggtcttgtcgctattttgttgttacgggtttaggggaaaattaaatgataatcagcattcaacaacgttctgaactccatcgccaaatttggcaaattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggaatgttttaatgaattgtacaaagtgcggtaagttttttaaggtttttgtatatgcaaaatgatttcagtttttttatctacgattacgaaagttttgggattaatcctgccactgacagaccggctcaattcgccggtattcgtacagatcaagattttaatattattggcgagcctgtaatattttattgtaagcaaaccgatgattatttaccgtcgccggaatcggttttggtaaccggtattacaccgcaaatttgtaatgagaaaggtattcccgaaccggaattcgcagagaaaattttagctgaatttagtcaacccaacacttgtattatggggtataacaatgtccgttatgacgatgagatgacacgttataccttttatcgtaactttattgatccctatgaatacagttggaaaaacggcaattctcgctgggatttaatagatgtagtccgagcttgttacgctttacgtccggatggaataaattgggcttacgatgatgatggaatgccgagttttcgtttggaaaaattaacacaggtaaatggtatagagcatggtaatgctcacgatgcaatggctgacgtctatgccacgattgcaatggcaaaattgattaaacaaaaacaaccaaaactttttcaatttttctttgaaaatagaggaaagagggaagttgagaagttgattgatatcgctaatatgaaacctttagtacatgtatcaggcatgctgggtaattatcgaggcaacaccagctgggttgtgccattagcttggcatcctataaatcagaatgccgttattgtttgtgatttagcaaaggatattgatgacttattggctaaaagtgcggtcgaattacgtcaaaatttgtatacaccaaaagttgaattggaacaacataatattttacctgtaccacttaaattagtgcatattaataaatgtcctattcttgctcctgcaaaaacattattaccggaaaatgcaaccaaattgggaattgatcgagaattctgtttgcaaaatttgcaaaaactgcgtcaatctccagatattcgagataaggtcattgaaattttccatgatgaaagagaagtaatacacagtgataatgtagaaactgagttatacaatcagtttttcagtaataatgataaaaacaatatgacgattttgcgtcaattatctccggagaaattaaacgagcataatttatctttttcagataaacgtatcccggatttattatttcattatcgagcaagacatttctataaaacgcttgatcgctctgaacagataaaatggcaaaaatatcgccaacgtaaactggaaaaaagtgcggttcaatttgaggaaagtttacaacgtttagtagaagagtatcaaaataatcctgaagaattattgttgttacaacaagtatatgaatatggagcaactttacttagtaagttatattgataatagcaatatctagaaatgcaggattaaaaggtatttggtaaataaaataaaagagacaacgtaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagcaacgttcacagctatgcgaggacgttgctttttttgtagtttttatttattaagctttttctccttaagaccacactacaaaactattacaaatcatctctctatttaataaagttaaataataatacctttcaatgtacaagggagtctttatccgtcttgcttagctggtataactggcttgtgcataactttgtgatttatttatatcgtagttttcactaaccgcataactaatttctyataatgtatattatgttaaattaaataattaaatatgtaactttttggctggtttgcccctctattttgctatgaaatcttctgttaattagatgagattaaaaaaataaaaacgataaaaataaaagcgagttttttatttttttatgtttgatacagtgtcactaaattnnnnnnnnnnnncataaaaaaagccccatgattttcatcatgaggcttaaaattttgaaaactttatttatacacgtttaaaatcaatatggactaattttggcttgaatggatggcgttgcatcgcttgtactttaacagaaatttccttcccttcaataactaggataatagtatccgaatagaaagaatcatgaatttgagcgttatttaattcatcatgatttaatacaattgaaacaggtgcttcactaccaccataaacgatagcagggatttgaccattatgacgcaggcggcggctcgcacccttaccttgcttagaacgaacttcagcgttaaatttaaatgacattttttatgttctcttgaataaaataaaaaaacaaaaaaaccgcaggcgacccagcgatttcccttacgttatgctaaaacttatagtcatgttttagacatggtgctgattataatgagttattctctataaatcaaataaaacattgaatttaaactggatatttctactaaaaaagctaaaatagccgtcatactttcttattataaatgggtagttcatggacttattaattaatttttttactgattatgggtattttgcagttttctttgttctcattatctgtggctttggagttcctattccggaggatattactttggtttcagggggggttattgcaggtttataccctaatgaagttaatgttcatatcatgctgattgtgagtatgcttggtgtgttaattggtgacagtacaatgtattggcttggtcgcatttatggtgtgaaaatattaagaacccgtttaatcaaaaaaatagtaacccttaaacgtttaaaaatggtgaaagaaaaatttgctaaatatggcaatagagttttatttgtggcacgttttttacctggtttaagggcaccaatttatatgatatcaggcattactcgtcgtgttagttttattcgttttctcctaattgacttttttgctgcaattatttcagtgcctatttgggtatatttgggtgattttggtgcaagcaatctagactggttacatcaacaaataaagaaaggtcaatttgcaatttatatcttaatacttctactcgcattgttcttattttggaaatggaaacgtagtaagaaaaaagatatgtaatttagaccatcttacagggcgtatttaattatgccctattttatttacggtatagtgattcgtaaaaaataaccatactcttctactttcgatacactagatatcgtataaaatattggggatatataatttaaaaagggtactataaaaagtaccctaatttatctttaaattaaagtgcagattttgctttctcaactaatgctgtaaaagcaactttatcaaacacagcaatatcagccaaaatcttacgatcgatctcaacagatgcttttttcaaaccgttgataaatttgctatacgataaaccgttttgacgagtagccgcattgatacgagcaatccatagttgacggaattgacgtttacgttgacggcggtcacggtaagcatattgaccagctttaattactgcttggaatgcaacacgataaacacgtgaacgtgcaccataataacctttagctgccttaagaactttcttatggcgtgctcttgcaataacaccacgtttaacacgagccattatctaatctcctattgtccatgaatcttaaaaaatttaactaatcgtatgattgtgcccaaaacgctatttatgcgtatggtaagcacgctactactaaaacttggtctgctttcgcaaccattgatttatgacgtaaatgacgtttacgtttagttgtctttttagtcaaaatgtgacgtaagtgagattgtttacgtttgaaaccacctgaagcagttttcttgaaacgcttagcagcaccacgtaaggttttaattttaggcattgtttataactccgcattgtttaagtttaacatcagataattaggcgaataaaaatacggcaattcataccgcactttactacttgaatttgcactaattatttcttttttggggcaagtaccataatagcttggcgaccttctaatttgccaggtgcagattcaacaacagcaatatcagcaagatcatttttaacacgttctaacatgtctaaaccaatatcttggtgagccatttcacgtccgcgaaaacgaacagtgattttagctttatccccatcctctaaaaagcgaatcaggctgcgtagttttacctgatagtcgccttcgtctgtaccaggacggaatttaatttccttcacttgtacaactttctgctttttcttctgctcttttgcagctttacctttttcataaaggaacttaccgtagttcataatacgacataccggtggttctgcatttggactaatttcaacaaggtctaaatctgcttgctctgctatatttaaagcttgttggatagatacaatacctacttgttcgccatcttggtcaatcaaacgaacttctttcactctaatttcatcattaatacgattagggcgatttgttgccggagctttttttacggttttaataatgttattcctctaacgattttaaactaccatcaaactgcaatactgcagaagacataaacgattgctgtatttttagcaaaaaacggcgagattttataagattttcaattactatgcaaggtattaaggcatatattgacaagttttataaataaatgcacttaataaaatacatagaacgcatagaatttgaataagttttttctttgttagcttttctgccggcataactagtttcctttgcactttttaaatttaaaacttcttaattattttatttaatgttatcatttcttgagttagatcaagttttgcattacacgcttttatctcagtttcaatgcttttgaggaatgaatgaaaacttttccctatgaacaaaaaattggacgacgagttcaatctactggttgtgctattcactgtcaagcttgtagtattagtcaactatgtattccgtttatgtttaatgaacatgaattaaatcagcttgataatattattgagcgtaaaaaacctattcaaaaatctcaaattttatttaaagcaggcgatgaactgacttctctctatgctattcgatccggctccattaaaagttatactattggtgaaactggagaagaacaaatcaccgcctttcatttacctggtgatttagtaggatttgatgcgattaatggtatgcgacattttagttttgcacaagctttagaaacatctatggtgtgtgaaattccttttgatattcttgatgatctatcaggaaaaatgccgaaattacgacaacaaataatgcgtttgatgagtcatgaaatcaaaacagatcaagaaatgattttgttattatctaaaatgagtgctgaagaacgtctagcagctttcatccataacctttcaaatcgatactctgctcgtggtttttctgcacgagaatttcgtctaacaatgacccgtagtgatataggtaattatttgggattaactgttgaaacaatcagtcgtttgttgggacgttttcaaaaaaacggtcttttatccgtgcaaggaaaatatattactattaataatatgtcagaactttctacacttgcaggaacgacaaaacctaaaattaaaatgatcggataaaaacttggacgcaataataagttactactttcgatcattttttaaagtacaattacttgtcatttttataaatattgcctattctatttctatagtttgtttccactggaaaaatatgtttattgtttttgcaaaatatcggaggttattatgcaatttaataatatacttgtcgttttaaatcccgaatcagaaaagcaatatgctttggctcgagcagttcgtttggtacaagaacaaaagagcgagaatagagtaagaattacaacttttatgacggtgtatgatttttcttatgaaatgtcaactttgctttcttccaaagaaagagaaacaatgtgtaaaagcattattaagcaacatcagcaagctgttcaaccatatctcgaaaaatatgcggatccgaatattgaatttaattcaattgttctttggcacagtaatgaagcggaagctattacaaatgctgttgcggaacataattatgatcttgtcattaaatatactcaggagaaggaatctttatcggcattaatttttacacctcaagactggcaattactacgcaaatgtcctgcacctattatggtagtacgtgatggaaattggaaacatcaacgtcgaattttggtagcggttaatgtttccaataatcaagaggaatatacttcattaaataatgaacttgtttctttaggaattgatttagcggataaattagaacgaggtaatattcatcttgttaccgcttaccctcccactccaattaatatggcaattgatttacctgaatttacaacaacagaatatggtgatagtgttcgtggacagtatcttttaaatatgaaagcattacgccaacaattttgtatagatgaagaccatactcacgtaagagaaggatttcctgaagacgttattcctgctgtcgcaaaagagctggaggctgaattggttgttttgggaacagtaggaagaacaggactatctgccgcattcttaggaaatacagcagaacatgttattagcaaattagaatgtaacttgttggcaattaaaccgagtaaaaaataacaaaattattacacgaaaatcctaacttaatcgttaggatttttttaaagtaattttaaaaatgagcctacggtatagaatgagccaaatactaaaataatatccttttctgtggcattttgtaccgcactttttactccctcatatacagaagaataagtttgagcagatagctcattagttgttgatatttgttgtaatgtcataaataattcatgactactctgccctcttacgccatctaaggttactaaattccactgatcaacaactttgattaaaggcgataatattccttgactatctttatcttttagaataccacataccgaaataatttttccgattgatttagctttaagtgcggttaatctttctaataaataggaagctgcatgaggattatgaccaacatcaacaataatttgaggtaattgtttaactgtttttttacttaatttagctaaatttaataatttttctgggttgattttctgaaaacgccctgccagttcaacttctctaagtgatttatgaataactgatatagaaatatcaaaaggtaaataagccaacgttgctaaagctgttgcagcatttgccaagggaatactacaaataggtaaattatccatataaatagctttattaccttttattgtttcccatgtccagccattttcctgtttgctgaatttccaatctttattacgacaaaataatattgaatctaattttttcccttgttctaataaagaacagggaatattgttttcaccaataacggcaggcttatttggacgaaaaatacccgatttttcaaaagcgatctcttctcgagtattacccaagaaatccgtatgatcgatatcaatactggtaattacggcaagatttgcatcaacaatattagtagcgtccaaacgaccgcctaaccctacttctaaaataacaacatccaaattagcttgcttaaagagatacaaagcagaaagtgtactaaattcaaaataagttaaagattgtgatttatgttgttcaataaaagcaaatgcttgagtatgttcttcatcagctaattcttgattttgaattcttactctctcgttataacgaattaaatgaggagaggaataaacaccaacacgaaatcctgagtttagtaataatatttccagtagacgacatgtcgtcccttttccatttgttcctcccacagtaataacaaaaggagcaggctgtaataaatctaattgttgtgcaactgttttgaccctatctaatcctaagtcaattgctttagcatgtgctttttctaaaaaacaaagccactgttcaagtggcgatgttgcaaataaatttaaactagacatcatcagatttttcttgaattaattcaggttcaacaaaaggggatggcatattcatgagcttgcttaaaagattagctaaagtttcacgcatctcagaacgtttaacaatcatatcaatagctccatgctccagtaaaaattcactgcgttgaaaaccctctggtaatttttcacgcacagtctgttcaataacacgaggtccggcaaatccaattaatgctttgggctctgcaatattaatatcacccaacattgcaaaacttgcagacacaccgcctaaagtcggatctgttaatactgaaataaaaggaacacctttttctttcatctttgccaatactgcactggttttagccatttgcattaatgagaacaaagcctcttgcatacgagctccgccacttgccgaaaaacaaactaatggacaatgtaattctattgctttttcagcagcttgaacaaattttgagcctacaacagatcccatagaccctcccataaaactaaaattcaaggcagccacaacaattggcatgccataaagagtagctgaaacagtaatcaacgcatctttttcgcctgtttctttttgggcggctgacagtctgtctttatatttttttaaatctctaaattttaaaatatctttaggttctaaatctgcagcaatttcaacaatgctatctttatccaataaagcaacaaggcgttctcttgcatcaatacgcatatgatgaccgcactttggacaaacttctaaatgacgttttaattcatcacgatacaacacttgctcacaggaagtgcatttggtccataccccttcaggcacatttgattttttgctatttgaagttgtatttttactaaaaattctatcaatccagctcatgtttaaccttttatttattaacttaaaactcgcctcattagaccataagtcgggggaattttccagaatttaacaactccgactagcctattaattcaagcaatttaactgccattaacgctagattaaagtgttgctcatcggctacagaccaaaattctattttattttccgccgcacttaatgtactaatatgcaatttcactttttcctcattgttttcattttctccgtgagtaaccggcgtaattaatttctctgcatgatattgaattagctcattttcttgccaaaaatgtaattggctttctatatcaaccaaataatctgaaagtgcagtcacaaactaccccattccataaaatacaggcacttgaatttgatgaaagacaatattctctaattgtgggtaaattttttgtaactgtataactaaattttgagtttgtacaggaaagacatcaaaggctaaacgttgctgttccgtatccagcggaatcccatttaataattgtgctgtctgtccagccaatttggcaacttgttctgcttctacataggaagcgggtaataatgaagtcacaaccaattgatgaatgctattaacaatattactgatagctaaagcacattgcgttacttgtggatttggaagggaaacaatatttctttggcgtaattcaatcaattgatcgtcattaatacctggtacaacaacgggaatatttgcaaggcttgcacaaatgcccagtacatcgatcacaatacaacctgaatcagctatttttgccaaaagatcaacatgctcaattgtccctgcaaacaaaacataattaaactctgtccaatctgcctcttcaggcataatttgaataactgctttattgttaaaacgaatgccttgctcttctttgaaaggctttatttcaataattgtcaagctttcaatttcaagctgagtgtgttctaaagtttcgacaattttctcagataactcaaattctgctgcaatagcaatacttaacatttttctctcttataaactcggatagaatgcagtgcattttacaaaataattcagggaaaagaaaatgctcctgtaattatttactaggaatattgctcagaaaattaacgcaataaatcccaaacaggacgacaattttccggtaacactagagattttcccaattcaatccaactacttggaaaatgaaaatcggaaccaacggaactgtataaatcgtactcttccgcccaacgagcaagtaataaacgttgatccttggtttgtccacaacctgctacttctattgcgtccccaccccactgtttaaaatcagcgataagacgttttatcttttttgttgtcatggtatagcgtaatggatgagcaagcactgcaattccgttggcttgatgaataatctctattgcattagggatatcaacccattgtgttttgacatatgcagattttccttgtgctaagtattttttaaaagcttgactaatgttaataaccttgcctatttgcactaaataacgggcataatgtgctcttgttaattctccattcgtcagtttttgcgtttctgcaaaggcgttggctacacctaaatgctccaattttttaccgatttcaaccgctctttgtaaacgaatttttgcctgctcattcaaaagtgcggtcattttttttgaattttcatcaaaacctaatcctacaatatggatactataattttcccaagaagtagaaatttcaacaccattgatcaatgaaatacctaattgttctgcttgagtacgagcttgcgataatcctgcaatagtatcatgatctgtcaaggctaaaacatttacaccttgttgatgtgcccttatcactatctcttgtggtgataaggtaccgtctgatatagaactatggcaatgcaaatcataaattttgttcatactttcctaaattacttatcaaaaataaaaagtgcgataaattttaccgcactttcacttagttatgtgtctgttttcgctattgaagggctttttctattttctcaaacaaatctttcgacaaattttccacttcgcttaagcgaactaaagcacgtttcatcaaagtttgccgttgaggatcaaaacgagagaaacgaattagcggttcaattaagcgtgaagcaacttgaggattactttcatttaaccttaacaggatctcagttaaaaaacgataacctgaaccatcgattgcatgaaatccttttaaattatgtacacaaaaactaccgactaaagctcttaaacggttaggattattaaaattaaaacttggatgttccattaattgttgcacatagtccaaagtattgtcttcaggtcttgtagcttgtaaggcaaaccatttatccataaccaaaccgtcttgttgccatttttgctcaaaatccgctaataattggtctcgacaaggtagttgagcctgtgttgccgattttaaagcatttaaactgtcagtcatgttatttgctttgacataatgtttattcaccaaattgttacctaaatctgtataagccaaataattcaaacagagattacgcaatgctctcaacgcaatatcttgctcagttacttgatatgtctctaactgaatttcattataaattttcaagaataactctttcaaattattggcaatatggcgttgcataaattctcgcactgcataaataccgtccggatcgatcgttttgaataattcggcaaattcagtttcttttggcagtgttaaaatcgttgttactaaaccaatatcttgctggtaattttctaatacttgataaagtgcggtaagaatttcagcagaaaactccagtgccagtccttgttgataatgaattaagttacgtcgtaactctgcattaaataacatttgagccgcatcccaacggataaaatcatttccagcaaatttcaacagtatgattaattgttgtgtattataagcataatctaattttaccggtgcggaaaaatcacacaataacgctggtacaggacgtgtataaatgttttgaaattcaaaaacttgttctttttgtgtaagatttaatacatcagaaagatctttgccatcagcctgtaaaaattgctccacaccgctttcatcgtataaagcgatttttattggaatatgtaaattgactttttccatctgatcggcagttggcggggtaaattgtgagattttaagttgataaacgtgatttttttcgtcataaaaatctgttacaaccaattccggcgtacctgattgactataccaacgacggaattgggttagatcaagtttattggcttgttccattgcaaggataaaatcttcacaggtcgccgccttgccatcatggtctgcaatataacgttgcatacctgcctgaaaacctttttctcctaataaagtatgaagcatacggatcacttctgcacctttttcatatactgtaactgtatagaaattattcatttcaatcactttttccggacgaattggatgtgacatcgggcttgcatcttctgcaaattgtactgtacgtaaaaattttacattattaatgcgattgattgctcgtgaaccggtatctgatgagaactcttgatcacgaaatacagtcagcccctctttcaaacttaattggaaccaatctcgacaagttactctatttcctgtccagttgtggaaatattcatgtgcaattacactttcaatcgctaaataatcttcatccgtggcagtttgcggattagccaaaacaaatttagaattaaagatatttaatcctttattctccatggctcccatattgaagaaatcaaccgctacaatcatataaatatctaaatcgtattctaaattgaaacgtgcttcatcccacttcatggactttttcaatgcactcattgcccaatgagcacggtcaaggttaccccgatcaacatataattccagtgcgacattacgaccgctctttgttacaaaattatcctgtaataagtcaaaatcacctgcaactaaagcgaataagtaacttggtttagggaaaggatcttgccattcaacccagtgacgaccatctttcatttcaccacaagcaatacggttaccgttcgataaaagataaggatatttagttttatccgctgtaatttttgtggtatagcgagcaagcacatcgggacgatccaacatataagtgatttgatggaacccttccgcttcacattgcgtacaaataccctcaccggattgataaagcccttgcaaagatgtatttgcactagggtttagatgagtaacaatttctaattcaaaggtattggcatttacgttggttaaatccaacacgaggctttcagcatcttgttgataagatttaaactcttcatcattgagtttgactgaaacaaattgaaaactatgaccatcaagacgtaactgtttgctttcaggattaagacgttgaaattgacttattgctgttacgatggtttgttgcggatcaagttgaaaatcaagataaatatcagtaacagtaaaatcgggggattgataattctttctatatttggcttttttttgcataatgacaacctaaatttattgagaaaaactgtgctaggatatgatttttcgctaggtatttcaagttataacaattaagggagcgtttcgctcccttttgaagttttgttacgctaattttaatggctcaattttccatattttttctgcatattctaaaatagtgcggtcagatgagaagaaactcatattcacaatattttgcaatgcactttcaacccaagcttcttgatttttatatttttcatccactgctttttgcatctcaacatagctacgaaaatctgcaaaagattgataataatcgtaagaacgcaatgaatttaacaaatcatgatagcgagtaggttctttgggtgagaaacaaccagcattaatctgatcaataacttcacgtaattgttcatccgactgataaatatcaaatggatgataaccattacgccgtaactcttctacttgctctacggtattaccaaaaatgaagatattatcttttccaacattttccaatatctccacatttgcaccatctaatgtccctagcgttaacgcaccatttaaagcaaatttcatattgcttgtaccggaggcttctgttccggccagcgaaatttgttctgaaatatcagctgccggaataataatttgggcaagactgacactataatttggaataaacacaacttttaaacgaccttgtaagcgatcatcattattaatgatatttgccacatcattaattaggttgatagtttgttttgctgccgtataagctgaagctgctttaccggctaaaataaagacccgaggtgtccaatctttttctggattagcaatcatttcattgtaacgagcaacaatatgtaacacattaagaatttgacgtttgtactcatggatacgttttacttgaacatcaaatagagcgtttgaatttaattcaatacctaactcttgttttacataattcgctaaacgttgtttatttttacgtttaatctctagaattgcttttttcaattcaggatcttgaatatgtgctttaagcgtttctaattgagttaaatctttacgccattcagtgcctatatatttatcaaataatgcggataaatcaggattcgctaccgcaatccaacgacgaggggtgattccgttagtgacattggtgaaacgttcaggataaatgcgataaaaatctgcaaatgtagaacttaccattaaatccgaatgaattgctgctacaccatttactttatgcgatccaacaacagatagccaccccattctcactttacgtatattaccttcctcaatcaatgatatacgacgaataaagtcgttatcagtagtaacagaagtgcggacatattctaagaaataatcgttgatttcaaagataatctgtaaatgacgaggtaatatcttcgccatcatttctaccggccaagtttctagtgcttcagacattaatgtatgacaagtataagagaatatctgacagcacatatcccaagctttttgccaagtatatccttcttgatcaattaaaatatacatcaactctggaatagctaaagcaggatgagtgtcgtttaaatgaattgcaattttatccgctaaattatccaatgtattataaattcgcttatggcgtttaataatatcttgtagagaagctgaaactaaaaaatactcttggcgtaaacgtaattctctgcctgcagctgttgaatcatccggataaagtactcgagaaacattctcactagaagatttttcttcgatagcatggaaataatcaccacgattgaatgacactaaattaaaagtttcacctgcgtttgcactccataaacgtagtgtagctgcactgtcattgctatatcccggaatcatttgatcgtaagcaagtgcggtgatttcttctgcatttttccaaatacattttttcccttcaaaataaatatgccctccaaaacggatattaaagcgtttagacggacgaataaattcccaaggataacctttttctaaccacgcatcaggtttttcaacttgtttgccatcttcaatatattgctgaaacataccatattcataacgaataccatatcccataccaggtattgcaagcgttgcgatagagtccataaaacaagctgctagacgacctaatccaccattaccaagaccgggatcaacttctttctccaatacatcttctaaatcgacattaagttcagctaaagcatctttagctaagtgatatacgccttcagaaattaaggcattagataaagtacgccccatgagaaattccattgaaagataataaactcgccgagtttcttcttttcttgcttgatgggcagtggaaatccagccctctgttactaaatcacgtatggcgtataaagttgcatttagccaatcacgttgacttgcctcctccggagaacgaccaattaaaaaaattaatttatatacaatcgatttcttcaacgaatccttcgtattttccggacgattataagaaaaaggaaggggaagtgtatttaccattaggctcaaactcctgatttaataaaaaactaccgaattttattcatctgtataaaaaaaacaataaaattttataaaaaataatttgaatatttctactcaaattatttcgctaaaaaatttatttatgtaaaagaatatcatatagggattgatatccttttgcagatgtctgccaactgaaatcctgttccatagcattgactatcacactttcccattgacttggtttacgccacaaagtaaatgcactatcaataccataacataatcccccaacatcagcatcattaaatacaaatcctgttgcatgacgtgctttgatgttttcactgctactatcaatgacagtatcagccaaaccacctgttgaacgaactaacggtaaagttccatattttaatccgtataactgcgttaaaccacaaggctcaaaacgacttggaacaagaatgacatctcctccggcaatcattaaatgtgataatgcttcatcatatccaatttttactgcgatattttccggatactcttgtgcaagccaattaataccggcttctaaatgtgctgaaccggaacctaaaattgctaattgcccaccttgttgtacaattctctcggcactaccaattagtaaatctacacctttttgctctgttagacgtgtaaccattacaaataacagtgcattaggattttgtggtaaattaaaataagcttgtaattttattttattcttacgtttaccctgcattgatttcaatttgtaatgatcttcaatatacggatcactatacggatgccaaattttttcatctacgccattcaaaataccaaccaatcgtccctgtgctttcaaagtttgcaacaacccttgtaaaccataagcaaattcaggtgttgtaatttctttggcataggttggactaactgcagtagaaatatcggaataatacagtccggcttttaaataagacatttcaccatataattccaatccatctacattaaacatccaccaaggcaatccaatttcagttagatgataaggtaaaaaacgtccttgataggctaaattatggatagtaaacaccgatttagcagggcgtcctttatgatgcaaataagcagctgttaagcctgcatgccaatcatgagcatgcacaatttcagcacgccaccaaaagtctaatcctgtagccaactctgccccaacccaagccaataaagcaaaacgcttatagttgtccgtataatcgttataccacatatcatggtatggattaccttcacgggcatataaatgcggtgcatcgattaaataaacaccaataccattgtattcaccataacgtagtacaacatgtccggcaaaattatcaaattcagcaactacaacggtatttggaataccacgagaaatagcaggataagccggtaaaacaagtctagcatcaataccaatttcattttgtgcaaaaggtaaagcccccattacatcagccaatccgcctgtttttaataatggatataattcggaacaaacatgtaatactttcattgttaattttaatcctcccatcaaggcggtaaaaataaaaaattctaccgcacttatttatatttacacctagtctaaatgaatttcagagacaactttttcgccatttaattttttcatcattgattcagttaccaaaataacttttccggtactacttacacggaagcgtttgcgatcctcttcaatatttacaccaataactgtgttatccgggataactacttggcgatcaataatacaattacgtaaaatacaatttttaccgatagttacttgaggcaacaccactgaatattctactttagaatcagctttcactttcacttgatcaaataacacagaataactaatttctgcatcagtaatcacacaaccaccggaaataagcgaattatctaccggtttaatatcttgcttgttatagaagaattttgatggataagtttgggtcggattaccgcgaattggccagcgttggtcataaatatccaattgcggatgttcagatactaaatcaatatttgattgccaaaaactatctaacgtccccacatcacgccaataaatctccccatccgtattacgtcccatacaagatcggctaaacggatgcgcatataaaacttcttcctctaaagattttggcaaaatatctttaccaaagtcatgagaggtatacggtgtatttacttcacgcatcaatacatcatatagataatctgcatcaaacacataaattcccattgaagctaacgaagtatccggtttatttggaatcgccggtggatcttttggcttctcaacaaatgcttttactttcaaattttcatccactgccatcacaccaaactctgatgcttgttcacgtggaacttcaatacagcctacagtacattttgcattgcttgaaacatgatctaagagcatttggctataatcttgtttataaatatgatcaccggctaaaattaaaatatattttggacggtaatgatcacgaataattgccatattttgataaaccgcatcagctgtgccacgataccaagtagaatcatcaatttgctgacgtgccggtaacatatcaataaattcaccacgttcttgcggtagaaatgaccaccctttttgtaaatggcgtaataaagaatgagcagcatattgcgtgaccaccccaatgcgatttaagccggagttaatacaatttgataaagcaaaatcaataatacgacggttgccaccaaaatataaagctggtttagcacgtttatctgttaattcgtgaagtcgtgagcctcgacctccggcgagaattaatactaaggtatctttaacaagtttatgtttacttaaatttttagtaatactgttactcatagcaactccttatcttttatttttatactcacgactaactcacatttacttgagttattcactttttctgcaacacaccaaaagccaaatccgtcatctccaactgcttgttttctaaatgtactacttttgaataacacaaaatctcccaattgccttgaggtaataagaatttttgtgaacttgtttttgcgttgataacgaacaggtatttactgtccagcaaaatctgcagagctttgctctctttattatgccactcatctaatgacatcttctcagcatcaatatttaaccaagatacattgctctcctgccaccaattatcccgttgtaaactcggaatttgtttacgcaatgcaataacttgcttaaccaaattaaagagatcttgttcaaaatattgccattttaaccatgttgtttcattatcttggcaataggcattgttattaccgtactgcgtattaccaaactcatcaccagccaatagcattggcgttccgtttgataataacaagctcagtaacaacgcactacgacttaaataacgagcttcttcaacaagagaatttccctctttatatccttccataccatggttataactataattctcactccgcccatctcgattatcttcaccatttgcccaattatgcttttggttataacttactaaatcatgtaatgtaaaaccatcatgtgcggtaataaaattgacagaattatgtggtaatttcccctgacaacgatatatatcactcgaacctgcgaaacgctctgcaaaaacaccgagttcaccgcttttccataaccaaaaacgacacatatcatcacgaaatcggtcattccattcagcaaaatacgctgggaaattacctacttggtatccacccatacctatatcccaaggttcggcgataaatttaactttttgcaaaattgagacctgctcaatttctttaaataataaggcattagcattaaaatccggcgtttctcgtcctaaaactgaggctaaatcaaaacgaaagccatcaacatgacattcttctacccaatagcataaacaatcaattatccactttcgtcctagttcagtggataaattaagtgtatttccacaacctgttagattaatgtagtttcccgcttcgtcctgccaataataagtccgatcatcaattcctcgttgactaaacgttggaaaatgcttttccgattcaacagaatggttgaacactacatctaaaatcacctcaattcccgctttatgtaatgcttttaccattgatttaaactctgttaagggtgttgtatcggcttgatttgaccaatatttggactcaacagcaaacatcgctaagggactataaccccaataattctgtagtcttttctcctgcaagtgcggttcatctaaatgataatttattggcaataattccaccgcacttacacctaattctttcaaataggcaatgacattttgatgagctaaacctgcataagtccctcgaattgcttgcggaatgtcctctcgcaactgagtaaaaccttttacatgcaattcataaatgatactttctgaccaaggtgtttggggtaaaatatctccttcccaatcaaaagatgacgattcaattaacgctttaggtgctaaatgtgcgttatctctctcatcttcaagtaaaaaccaagctctattttctacacaacttaaatcaggtttacccacaacagctttcgcatagggatctaacatcaatttatttggattggataaagaaccgtctacaccatgaatacgaaaaccatattcagttccatattccaattcagctacccaaatatgccatatattttctgtacaatacattgaataacgggtttcttgaacagaatttttattaaaaatacaaagttcaaccgcacttgcctgtgaggaatagattgcaaaattaaatcctgcaataccttccatacaacattctgtacaacctaaaggatatggtttacctaaactcatcttactcataaatattcaaattgtttttatacctttagctaacgttgttttctactgatgtcgattctgcaatcacctctgcatttggaaaaacagcactttcctcgttttttacttttttaactaccgctctttttgttaccgtctttttaggcttaacctctgttgcctcagagacagtatcagcgacagtttttttggttctcgtggttttaccctttgctatttttttctctgttttcaccgctgtatcttcaactttcgaggtttttctcatttttctgactttttttactttatgcagtttaagatacactgttgctagaggagggatatcaatactgatagattgtgctttattatgactttcaatatcttcagttacaattttgctcgtatttgtcgaatttgatcccatatactgttgtgcatcggagtttaaaatttccatatattcaccggcaatatttacaccaaaacggtaattttgacgtaaaacaggggtgaaattactgataacaataatacgttcatcttttttactacgacgctcaaaaacaaacacggaattttgataatcatcaacaacaagccattcaaaaccttgtggatccgtatctaactcaaagagcggtgcatttttttgataaatatgattaagatctctaacataatcctgtacagctttatgccagccaccaccatgaaattcatcaagaagataccaatccaaactttcctgataattccattctctgccttgagcaaattcattgcccataaagagtaattttttacccggataaccccacatataaccataatatgcacgtaaattagcaaatttttgccacgcatctccgggcattttaccgagtaatgaacatttaccatgtacaacttcatcatgtgaaagcggtaaaataaagttctcactatattgatacaccataccaaaggtcatttggctatggtgatgttgacgataaatcggatcttttttcatatacgacaatgtatcgttcatccaacccatattccatttaaaatgaaaacctaaaccaccttcatacggaggatgagtaacaccggcaaaagaggttgattcttccgcaattgatacaacaccaggaatttccgttcccaataaatgattagtttgtttcaaaaattcaatggcctccaaattttcacgaccaccatactgatttggtatccattgcccgtcttcacggctatagtcacgataaatcatagacgcaaccgcatctactcgaataccgtctaatccaaatcgctccatccaatacaacgcattcgaagccaaataattttttacttcatgacgaccgtagttataaatcaaagtattccaatcttgatgataaccttctttgggatccgcatgttcatataaagccgtaccgtcaaaagcaactaaaccgtgcgtatcgcttgggaaatgacctggaacccagtctaaaatcacattgattccagccttatgagctttattcactaaacgtttaaaaccttcggctgtaccaaaacggctagtcggagaatataaaccaataggctgataaccccacgaaccgtcaaatggaaattcagacaggggtaaaagttcaatatgcgtaaatcccatgtcttttacataaggaataagctcctcagcaatttgatcataatccagccaaaaattattttccaagttacgacgccaagaacccaaatgtacttcataaattgaaatcggctgatcagcttgattagcttttcggcgtttttcagtcattgatacaatttcaggcaatgccccaatttgtgatgctgtatcaggacgtaattgtgaactgaaggcataaggatcggcttttaagcgtaattgattatgacagtctaacagctcaaatttatacagttgccccaacgatactttgggtaaaaataattcccaaataccgctagattgatgaaaacgcattgggtgccggcgaccgtcccaatagttaaaatcgcctacgaccgaaacacgtttagcgtttggtgcccacagacgaaaatttacacctgctacgttgtcacattcggtaaaatgtgcacctaaaatttcataagggcgtttatgggagccttctgccagtagccaattatcaagttcattaatcatcggatgaaatgcgtaaggatcttctataacttgagcttcatttccccaataaacttctaattgatacgcaaaaaaactatgcgtattaggcacaacaccggcaaaaaaaccacgttcatctaccctcgataattcacaaagtacattttttgtttctttactgagaacaaatactttttcagcatccggtaataatacccttacttcaatcccatttgacgtttcatgcatacctaacacggaaaaaggatctgcatgttttccatcaaaaaaagtatcaatggtagattgtgatacaaatttattcataaaaaccctgcctatttatttcttgcctgattaattgttctaattaatgaaagtactgttttatcagtaaaaattttttctagcggttgtaataatttcttacgccagttaggatattccgttgaagtaccgggtaagttaaaagaaacctcttgattaagtaaattttccagttgtatacctattaattgcgtttgactttcagctaaatattgatgaatgacatgatttaaattatcgtgcattgccatatttaacgcatctccccaataatcaggcggtaagtattgatctcggtgcaaagtattaagcaacgcttgtttatctactactcgctgatcatattttgattttaaaacatcttctttcaacatacctaattgagcaaacagttctaaatcacgacagtgccaaaaactctgcaatgaaggaagatcatgagttccaactgtagcaaatgcttgcaaaggaaaatgatctgctttcggatattcgttgtgttgttgctcaaaatacagaacaaaataagagaacactttaaattcatccaatttaaaccgcacttcattaggtacagtacctaaatcctcaccgacaattaaacattgattacgctgactttcaattgccaaaattgccatcaactctgcaaaaggataatgtacataaagtccatcacaggcactttttccttccggtattaaccacaaacgaaacaatcccataatatgatcaatacgtaacacaccaaaatgctgcatattggctcgcaacatatcaataaaaggctgaaagccacgagcttttaaaattgttggattataaggcggaatattccaattttgtcctaccggacccaaaggatccggcggagcaccaactgaagcgttcacacaataaagtgtttgatcggaccaaacatccgcacttcctctcgaactgcttacagccaagtctccataaattcccaacgatagacctttttccaagcacaagttttttacttcagttaattggatagtagccaaccactgcacccaagtgtaaaaatccacttgtgttttatatttacgtaacaaatttttgcgttctttatcagttaaaatttgccattctttacgccaacctaaccaaccaattttattttcatcttccggcatattttgatgttcaatactatctaatacgtcaaataaagcctgagataataaagcatcaccttgtgccttcacaaactcagcaaattggcgacgacgctcaataattttacttgctctgctacgcttaaaataagcgaataactcttctaatgcagaacgttttaatgacattactgcctgataatctacgatatcagattggcacaactcagtcagtttagcttgagtattctcttgtttaaaccaattttggactttttgacataaattaaattcaggtaatttatctactgccaaatataaaaaattcaaccaacgtcttgaagaagaactgtaaggacttgcccattcaggaatagccggataaagttgatgtaacggattaattccaataaagtcagctcccagcaccgcacttttctcaattaaatatgcaagatcggcaaaatcgccaatcccccaattgcgtgcggaaaccaaactataaagctgaacattaattccccatgcttttttacgttgaaatactgtcggttgataagattgttgaggcgaaactaaaatgcgaacgacatagttctttccatttatttcaagaagcaacgaataataaccataagctaaaggagataatgttagttttttctgctctttaagaagttggctccgagacaggaagttcccattatcatcatacaaagaatattgaatagaaatgccggaagataaattaaatgcggttaagtcataaattataggttcattttcactgacgactattacatcatcaaattttttatcttctgaaccgacttccgtttgactcagtaattgaatgaaataatgcagactttccggttttgcgtaaatcaaattaccatcaatatcataatgagatatggcaatccctattttttctgcatcttgttgtaattgattagaaatgcccatcttactctcaaaaagcttaaaaagaattaaatcaatttcattctatctaatcttaactgataaaagcaaacgcattactttaaattgtgatccagttcaaatagaaattttaagttttttcatcaatcacaaattcaaaccaatcaatcacatctttttcatgaataccctgctcaatcatcacaccagcacgtttcatcgcttgagaatgaccaacgatgagaggatgccaatcaaagagcggtttattttcataaagtaaacgataagcacaagtactgggcaaccaactgaaatgtggcaaatttgctttagttaattttgtacaatctttctctaagcgaaaacgtttctcataatgaccgcactttcccgtttctaaattcaatagattgcaagcaatacgagtaaaatacagcttttgtcgttttcctcgcccttcaataaacttacggtaacagcacttgccacaaccatcacaaagtgcttcccattcttcatcgttcatttcaagcaaagatttatatttccagaattcaggggataaagtcatttcgaaaaaaaccgatactatcatcttaaaaaaataatccggttaaatattattcaaccggactcgtagaatattacccaattcagggaatgcggaatttaaccgcacttttattactgtgtcaatattgcttcaaatctaaattgagatggcaaaattttatgggctaaagcctctatattttgttgagttacttgctgtaataactgttgctcagcaaacataagcaaaggaccatcactcaaagaataactttgttccaattgagataaaatggctaacaatgattccttcgcctgttttaactgagattgtttttcactcacttttttagccaacaattcaggctcaatgccttgtttaagtatttgatctaatacatgatgagtcatctgcgttaattcctgtacacgcataggatcacaactaaactctattttcccctcaatttgaggtgaaaaatgttcttgttcaaaccacgcatgcactgcatagatacccgatgcctgttctcttaaactcaaccgtaatttctcttgtatgatatccgctaaaatatccagtaaatatttgttttccacttgccattgatgatcagctgcgaaatacatttcaacttctgctcttggctcatgcaagcctttaacaactaaacgctgctcgggtacatgtgcctttatcggctgtaatactctattttgtgttttaaccggtacattggctaaatatttttcagccaaattttgtaccgcactttcgctaatatcaccaacaataaaataagtgaaatctgttttatccgtaatatattgctgataaattgcggaaagtttatctgccgttaaatgcagattactgaaacgatttgcaccatatagcgtttcttgttgtggaaaacgcaattgctctactttctgcataaacgtcttttccggacttttttcattcacttcatcctgtaaagtttggcgatattcggctaagactttctctgaaacagggctggtttgtagttttaacctaaataatcgcagaatatccgctaaactttctgttttacctgccgccgtaaaaccctgatcagcctcatcaataaccgtcgtaaaagctatcggagcgtgactgaaatactgatcaatatcagcctgaggtacaatgccaattccagtatcatcgaccacagaaatcgccgctcttaacgcatgataatgtgatcttggcacagaacgtaatcctcctgctgtcaaggctttaaaataaacttgttgcggacttttatcactatacatataaatcaatttactgccgttacttaacaaatattcagtaattttttgtccacgccatactttttgcttagtggcattgcccgcaactaaatctaaatgcggaagctgaactaccctattatcttgttgttgccaagaagattgcgattgctgtaaagcctgttgccatttttgtgccaaccattgaatatcaaacgataatttgtgcggttttggctgagtaatcagcaccaacttggactttaactgcaacatttgttgaaaagtgcggttaatatctgccaaagtgagttgattgaacaattgatgatttaattcatattgatctttcggagaaagtagcacttgatcatttgccatggtaacaactaattcatcagcaattttgatactactcacttccaaatgtcgttgtttagtatttattttacgcaaacgctgaagttcatcatccaattccgtctgcgtaaacccgttttgagcaatttccgcaataaagttaaagagttgctctgtcgctttttgataatcctcattctcaagttgtaaagaaaatgtggattgtaacgtttgcttacctaaataatcatgataaaaattagcagattttacgaccgcacttgaagactgctgtaaatatgtttcccattgttgcaaacgtaaattaagcaaacgtaccacaatttgttgccataaattctctcggtattgtgctaccgtattgatattttccgccggtttaaaaaaactcaagtccaatcccggttcacgcatttctttctcagacacggtcgctaaacgccatttaggcggtaaaggaatatcaaaatcaatctcgggtaaaggttggtgttgtagcggatggctactccctaatttctgttgaattaaagacttaatttttactggattcacatcgcctaccacaataagactgacattatccggacgataccattttcgataaaaatcttttacacgctgtgccgaaacatgtttaatgacgttgacatcaccaatcggatctcgttctacataacgtgaccccgccatttctatttggctttttttatcccctaaacgcaacatagggcttaagcgtgaacgccattcttccaacacaattccacgttccgcctctaaatccgctggtaaaatggtaagatggtttagccattgatcaataacattgaatgccaagctaagagattgcagatcatttttagcgatatttaatgtataaaccgtattttcaaaatcggtaaacgcattaatatcacgtgcaaacttcattcctaatttctcaagtgcattaataatttgattttgcggatattgttgcgagccattaaatgccatatgttcaacaatatgggcaacccctttttgatcatcctcttcgtgcattgaaccggcattaactaccaaacgcatatacacacgattttgcggaaaatgattaggtaaaatgacataacgcaagccattttccagttgtccttggtgggcttgcgaatgaaaaggtaacgtatctttttcatgaaataaggattggcaagcgccaatccccaaaagagcggttaaaattagcaatattttttttaacattagaattcataccctaattcaagccaaaattcacgacctgctgcgtaaaaaccataatcctctttagaacttaacccctttctcgtttgattaaggacattcaatatatcaaatttcacaatcgcagaatgtttgccaaagattttaggttgccaacgaaggctggtatcccattgtgtatgagtgccgtaattgtaactgcgataaatcggtaactgactacttccacgacctgtgtccaattgattaaccccttttataggtgcttttacataaattcggttggtccattccaaattataatttggcatagacatatccacgccaatccgagccatccattcttcacgattgttattaactttagaccgcatttctaattcggtcatttgttttccgtctaaaatcacaatggaattcgggtcatatcctacacctatatcaatacctttggtatttaaccaatcaaaccctagcgaagctcgccattctgtctgccaaaatttccaactgtctttattttgaatttgcaacgtatatacattattgctgtaatctttgcctcgtgcaaaatgacgcacttttttacccgatggaccatcttcttttagtatgatgcggtttttattttgacgatgaatatatcgggcatcaaggataacattcccgagttcttgattaattccgaaacttagctcatcgctaaagggcgttttcatggaggcaacggactgataacgtgtcgttcccttactaccatctatatcatctaatttgaaaattccttcacttaatttcatggaggcaaaagagcggccataataacggtttgctccgaggcttaatttggtttgttcaaagggttgatagcgggcgacaaaacgaggggcaatattggtatttttcaggaaagtatcacgctctaaacgtaatcccggacgaacttcccatttaccccccagcttgattaaatcttcgacataaagggcgatattgtgataatcggtttttactgttcctttggaaacggaatttgaagaaagaggactttccatactatcctgcatgaaaatttcagatttagcattttgatcacgttgaaaacgatagtgcgtaaattgccagataccccctaaggaaatagaatgttcagtacgtccccaagtcaacggatccatagcaaattcactggaaaaatgcacattgcgttgcgttaaagcactatctcccattcctccacgttcataattaatcggatcatagttttcatcaaatgccaatatttgcttcaaataattagaggcggatttacgcttatctgcaaattgatcatacgccaatgtattagttaacacaccgctctttaacgaacgaatccaagctaaagtggcaccataggcttgatgataatcttgcacattgctatcaacatttgtatcaaagaatttagtttccacataattagaataacgcaaactcaattcaaagcgattatcctcattagcaagccagttaaaattcaacaacgcattatcggaacggcgtttatgtctgcgattatccgaactcaacttgtcatcttttcccagcactaaacgacgttgctgaatatctgaagtacggcgactaaatcctgctaccataccgatattttcccctaaagaatgttgtgcagaaaggctgaagaaatctttgctatatttaggttgaaaatccgcactactaccgttaggcgaggcttgtttaaatttttcccgatctttttcctcaagatgaaacttcgcccaattagaatggctggtacgataacgcagttgcacaccatcggtaccatcgtattgcttggttttggcgactacggcaccgccggcaaaaccgcctaaactggcggaaatatcgctgtcgtaaacggttacggaagacaataaattcgcatcaaagaaataggcttgtgcatgacttgccataggcaaagtttgcatcgctccatcaaaaatagccgagtcaaagcctaaatcattattgatattgacattatctacaaaataactggtttgattggcttccgcaccattaatcgaaatgtcagcaggtttaatttcacctcgttgaaaactgttttcatcactacgttcaaaacgcacatgagaattggttttcaaaaaatcagaaatattgccgttggaattaggggaagatttaatatctttggcggttactttttggctggaagataatcctgcgttttgctctgcataaacaacaacctccggtaattgattagctcgttcaactttatttttacttgtttctgcttgagcggaaaacgctaaacagacgctgacagctaataaggtttttttagtttttaaatcataagctgacataacttttccttaattagatataaatgataataattcttataaattttatcatctaaattttttaatgtaaaaatgttcatcgcttgcagaaaaaaaataatccgaccataggtatgatcggattatgtgagaggcattaaaatcattaaatatactcagtaatacaaccgcacttttggcggaaaggaactgatattaaaacccttctttcagactgacagttagattaaaaactaagttatccgcattactgtctttgctatcggcacaataatacccttcccgttcaaattgatacgcttgttcagctttggcattagcaaggctttgttcgactactccacgcttaatgattaaggaatttggatttaacacttcattaatgtcttccactgctcccggattcgctacggtaaacaatttgtcatacaaacgaaattctgccgataaattatccgttgctgacacccattgaataacacctttgactttgcgtccctcaggatttttacctaatgtttcgggatcataagtacaatatactgtggttacacaaccttccgcatctttttcaacacgttccgctttaatcacgtaagcattacgcaaccgcacttctttacccaacaccagacgcttatattgtttattcgcttcttcacggaaatcagcctgatcgatataaatttctttggtaaaagggagttccctcgttcccaattcttcacgatttgggtgattaggtgcggtaagtatttctttcccatcaaaattttcaatcacaatttttagcgggtttaacactgccattgcacgaggtgcgtttgtgtttaaatcatcacgaatacagctttctaatgcactgtattccaccacgttatcctgtttagttacccctatacgacgacaaaactcacgcaatgatgcaggggtataacctcgacgacgtaaaccggaaatggtaggcatacgtggatcattccaaccgtcaacaatcccatcattaaccaatttcagtagcttacgtttagatgtcaacgtatattctaaattcaaacgtgaaaattcatattgatgcggtaatggacgctcaatcgaaatattatccaatacccaatcatataaacggcggttatcttgaaattctagcgtacataatgaatgagtaattctttcaatggcatcggaaatgcaatgggtaaaatcgtacatcgggtaaatgcaccatttatcacctgtttgatgatgacttgcaaatttgatgcgatatagcacaggatcacgcataaccataaaaggagatgccatatcaattttcgctcttaaacttgccgcaccttctgcaaactcgccttttttcattttttcaaataacgccaagttttcttctacactgcgatcacgataaggactgtttttacctgctgatgtaagtgttcctctatactcacgaatttgctcgggtgaaagttcatcaacataagccaaccctttttgaattaattcaattgcataactatacagttgatcgaaatagtcggaagcatagcgaggccccccctcccattcaaaacctaaccattttacatcttgcttaatactgtcaacgtattccacatcttcttttaccggattggtgtcgtcaaaacgtaaattacatttcccctgataatcttgtgcaataccgaaatttaagcagatcgatttcgcatgaccgatatgtaaatagccgttcggctcagggggaaaacgagtataaacattatgatgttttccactagctaaatcttcatcaataatttggcgaataaaatttgttggtttatgttccgtattttccatttcaactgttatttcgctcattttttgtcctcaatgcaatttgataattaaaaatctgcgtattttacagtgttttgcacagaatacaaagcatagcggattttatctcacttggcatatctgtacattaccttttgtaaactttcaggtaaaatagcataacttctaatacaggtatttttataccgcacttatttttcatgaaaaggaacgtttatgtctgatttgaccctacacagccgacatacctatttagatcaagtcaaacacattgtggcaatcggtgggggtcatgggttaggacgtgtcatgtctgcattgagctttatgaatgagcgtcttaccggtattgttactacaacagataatggcggctcaacagggcggattcgacaaactcagggcggcattgcttggggtgatttacgcaattgccttaatcagatcattacagaacctagtacagcatctgctttatttgaatatcgtttttccggtcaaggtgaattagcagggcataatttaggtaatttaatgctgaaagcactggaaaatatgaatatccgtccaacagatgcggttaatttaattcgagatcttctcaaagtgcggtcttttattgtgccaatgtctgaaagccctgtacaccttgccgcctccttgtctcccggtaaaagtatcgttggagaagtaagtattgatcaattaaccgaaatccctacatctatttttttagttccattagtacaggcaaccactgaagcaattcaagccttaaaacaagcggaagtcattttattcggtccaggtagcttcttaaccagcattatgccgccattattactaccagaaattattgaggtgctgaaaaatagtcaagctaagaaaatccttattgataatttaggtgtagaacacggtcctgccgccaaattatctttaatcgatcgcattcaatggattaatcaaactattggttgtgatattattgatggtgcgatcgttcaaagcaagccgcaacagaattatcacgcctcctcaataaaaatcatggctcgccaacttaaagccgatgatataggctaccgccacgaccgcactttactttgtaatgcgattgacgaattattgatagaattagctcatcatttttcacctaagcaagtttgactaatttagctggaattccttgtctaacagcggagccacatacccaatcaacccaaggcgaggcaatctctttggtattatctaacaaaccaagatcattaatattaactccggaaccaatctgagcatgtccttcaattaatttcccattaattgtataacctgtggcccccagttgtttatgtccataaccatgttcaatcgcaattgtccctttaatgacaccgttcatcacaaccagctgcacaacagcttttcctcctggggtatttagctccacaagctcaccatgatgtaatccatattccgtagcatcctgttgattaattgccacaataccattaggtttaatactatgtaatcttagcaaaggtgctgtaatactactcattaaatttgatttaaaggaaattaatttaaatggccattgtattttagggtaatggctttcaactgtgctattatcggcaaactgatcttcaaaatacgttggacagccgtgataatttttaccggtttgagcatgtttggcttttgctacattttcattccaaatttgcaaacagtttttccagcgagcctgcatattatcttcctgccatgcactgctatgaggagcaaaacgtccgcctttacagtaaattgtagccactttcttaatttcttcaggttttaacacttgttgtaaacttggcatcaaacgttgtacacctgttagcaataaatcttcttgagttgcatcttgtaccggctgttttccatcataagctatattggcagctgctcgtaaaaagaagtcttcactacgatttaaaggataggaatgattttgtttatctaagatagcattatcaccaaatccaggtaattgcatcatcttagcaatttcgataacaaaactttccatacaaatagtatcgccttgagatgttttctcattaggcgatgctatcacaggccagcgggcagtactggtttttgttggaacaccagcccaaggggtactaaatccccaactctcaaaattatgggtatccggcacaatataatcggcaagggcggtagtttcattcataaaagcatcaatagaaataaagagcggtaagattttcggatcttttaatttctgttgcgtaatatggtgaatacctgtcataccataaattggattccccatatgattaatccaagctttaagtgagtatggatagccttgtaaggcagaggtaatcatttctgacatttgcccgccaacaaaaggataccaagcggctttcgctggatatggagaaataccttgtgctactttttgtttaaattcactggatttttcataatcttttttactacgagctaaatttgttcctttgggtttaaccatattggggaaatttgcaagattgtaacgaggtccggcagaaaaatctttaaatttaccgccactcatactcatccccccttttttattcatatttcctatcatggcattaagtaacaatatcgcccatgctgtatagaaaccattgctatgcatagttccaccgtgggtaataactgccgcacgaggtccgtgagaagtaaactttttagcaagttgaataatagtatcaacaggtacaccacactgctcagaatattcctcgatggagtatgaaaaacaagattctttgaataattgtaaagctgatttagctaaaacctgtgagccgtctttaaggcttatcctgtcttccacaaaaagcaccgcactttggcaatctttggcagctataaatttgcctgtttgtcgatctttcaccaaaatatcactatcgctcaatttttcaggttcgggtaaatcctctatatgaaaatttctaatggcttgcccatactgcttatgatttggatcggcgataaataaatgtgttgcattacaaaaacttacgccattagcttgttgcatcgcaatttcacttggtatagacaaataatcttcgttataacgttcattttcaataatccaacgtaacatggctagtgctaaagaaagatctttacccggaataattggtacccagcgatttttatcttgtgctgcagttgaggtaagctctaaacgaggtgctatcacgacatattcaaaattatcctctgtacgcttcttagcaagctgacgagattgacgtttaaatggatttccggattgtgcaggagaagttcccataaacaaaataaattcaacatgatcccaatcaggtttagcatgagaattattagcaaagtcattcataaatgcaccggatccggcacgataggataaaccacaaaaagagccatgagaggcgaagttaatggtaccaaaactgttgtttgcaaaacgtttcagaagaggttgtcttccttcaggacctgcgaaggttaccatcagttgatttacttttgcaccaaaatcagggtgttgtgcattcactggcgtttgcaaatcacgaatcgcttttaatccatctacatgcccctctccaaatagatctccgccattcacaacttcatcaattaattgctcaaaactgatcgttttccatttaccttctccccttttacctactcgcttaagaggttgtgtaatacgataagggctatttatcccatctaaaaatgcagctccacggacacaagcagtagaacgttgctgtaagccattttcaccagaaacgcttaactctgcttgtttaattgattgattataatcaaggtaatgatctgatgagagcgggtgataaggattaccgttaatacgcaatactttatttttttctaaatctattcgaacccgtaaaccacatagagtccagcaccccatacattgggtattacatactacttgttggctattggttaataaattgccctctttgacttgatattcaggtaataaagaatttccatttatattgtcttgtgttttttgtcctgaagaaccttcaattacgccctttgcaatttcttttactttgggagaataacctgcaacaaaagcagtagcggcagttgtagccaaagctccttttatcaaattacgtctttgtttattcatgatcttttctccccaaatttgattgcaatagtgtatgagatagcagttgccataaaataatacctactaatgaccacaagctaaagacagctatcattccaattagcccatctacgttccaactcaattgatatggatttaccaaagcgttatattttgcgatttgctgtacttcaattaataaaatccaacgggtaagccaagtgatacaaagtgcggttaatattcgtaataaccttaggaaagttgaatgaggcaataacagcaatatgaacaaaacgaagatcccgatgagtaataacatcggtgaatagctaatttgccataatttcattaaatgaatagctgtttgctcagaaaatagataaagccctaaaatagaaaccgttaaccctaataaactggcgatagtaaagtatctgagagcataaacttgaggtataaaataatgacaaaataataagctgacgggtaaaacactaaatacgagcaaaggtaaaagccaagtgtgatgccataaaggacgagcctgtacagtgaagacctccatcgtggtatacattaaaatcaatattgtcataattaaagaaagccaaacaaaaaagactttaattaaatcagtattgaatttcccccaataaagccagtgaaaatacttaggaatagattgcattggaactgaggtacgtaatgaacataaaaaatatcctgccacggataaaacaaagaaaggtaaaaaccatgctccccaatacatccaagaccatatcgttgggttcaaataaaaattcataatacgacccggttgatgtaaatccgcagttaaggcaataggtgcaacaattgcacaactgaacgctaagctaagagcaagcaattcaagacgtgaatttttaataaaatgaaagaagaacgcagtcaaaacagatgaacaggctaatccaataaagaaaaaatagcttaccgcccaaggtagccaagcaatagcttgtggttctactaagatctcacgaataatcattctgctttctccttatcttgccataacattggttgaccgttaacttcattcacaaaagcatcatctaaacctagataaaatacatgtggaatggtaccgtgatccggttttaaaaccttcaaatcatctttaaattcatctaccattttactaattgtactggttggatcccgtaaatccccaataatacgagctcctcccacacaactctctacacaggcaggtaataatcctgcttctaaacgatgagtacaaaaagtacatttatctgcagttttagtttctgaattgataaaacgagcatcataaggacaagcttgtacacaataagcacaaccaatacagcgtttgttatcaatcacaacaataccgtctttacgctgataagttgcttgtacagggcaaaccggcacacaaggagggttatcacaatggttgcataatcgaggaagtagaacattattggtaatattctgttcattggtgacttcatattgacgtacggtagtgcgaaactcgccaagtggtgtttgattttccaccgaacaactcaccgtacaagattggcaaccgatacaacggcgtaaatcaactaacatggcatagcgatgagcttcattaccctcttttctttccggctgaaaacttgtattcgcttgagaaaaagggataaaagcctgcccaatagttagtactgataagtttttcaaaaaacgtcttttgcttatgtacataatcactcctacctctaataaagattgagcattcaagttgatcaattcaggttgtctgaatatcaatgcctagtcttcccactcacaaataaaatatttaataaaattgagttgttacctcttttagcgtattgttaaaaaatctccatgaaaaaaccattgtggttttccacataaaaatatgaggatattgatcttcatcaataaaaggaaataaagtgagaaagtgcggtcagtttttaaaaaattttatgttaataatggctttattgccccagttagcttttgcacaatcttggaaaatcggtattttggcacagcgaggaattactgaagcacatgagcgttggcaaccttggattgattggctaaatcaacaatttgatgaacataaccaattttcattagttactctcgatcttaatgatctagagacagaacaagcacaaggagttgactttattttaagtaaccaatcccaatttttttatttaaataataaggaagttcgttggttggtaacattaaaatcgctaagacaaaaacaacatgacagcacaggaagagttggtagtgctatttttgttcgtagtgaaagtaatttttatcaattgaaagatttgaagaataaacgtataagtgcggtaggaaataaagcatttggcggatttttattaggttataacgaattatataaccaaggcttgatggaaaataaagatttcaagccggtttttacgggatttccggtagacaatacactattttttttaaaagagaaacaggtagatgcggcaattgttcccgtttgtatttttgagcaattggtaaaagagggaaaaataaaggctgaaaatttccgtctattggcagaaaaacctaaccacattggttgtctggcgagtacagtcttactacccaattggtcattagctgcaatgccacaagtacccggtgacttggcatcaaaattaataaccctattgcttaatcaagcgtctgataatcttccgcaatggacacctccatattcaacaaatcaagcggataatatactgcatcagctatataaacacccgaaacaaaatttatggcaagcaataaaatattggttctcacaatatcaattttggattactggtattattctgcttttattcgttaattatatttggataaattggcagatacatagaaaaagtaaagccttacaacaagcgtatcaacaacatcaaaaatatgaacaacagttgatacaggctgatagactttctattcttggagaaatgagtgcaggtattgctcatgaaattaatcaacctcttactgctattagaatgtatgtggaaggtatgaaatatcaagcagaagaacaaagaactcaaatcatattggataaaatattacaacaagtagatagaagtgcggagattattcataacttaatgaattgggtaaaaggaaaaagtagcgaagatattgagttaatcaatctcaaacatttactaaaaaaagtgactcaattcatttctctacaacattataataaatttcaaattaatctagtttgtgcaacagatatttatttggaaataaaaaccacaattttagaacaaattatctgtaactgtttattaaatgccttacaagcaaaagcatcaatgatagatattatagtagagaaagagcaaaaagaactaaaaataagaattttggataacggaacaggttttcaacaaatagagttggattttccttttgttcctttccgcacaagtaaaaaacaaggattgggcttgggattagtattgtgtcaacgtctaatccaagcgatgaacggtaatataaagctatcaaatagacaggatcaatctggggcagaagtgaccttaatcttacaaataaaaggaaaatagtatgaatattcatctacttgatgatgacttaacaatacttgatgccgctagttttttattggagcaagcaggttatcaagttaaaacttggtctaatagtcagcaatttgtacaacaagctaatatttttgaacctggaattttgttattggatatgaaaatgcctcatttagatggaaaagctgttcatcaatttttacagcaacaaaatagcccttttgctgtaattattatgacaggtcatggcgatatccaaatggcagtacaagaattcaaattaggtgcagtagattttttacaaaaacctatgcaatttagccaattacaatcagccattaaactggcgagaaaaaaaacaatggagaattatgaacaatatcaaatcaaacgatgttataagcaacttagcactaaagaattagaagttttatctttattattaaaaggttatattaatcgacaaattgcagaaactctaaatatatccgtcagaacagttgaagtacatcgttcacatattatggaaaaaatgcaagcacaaacagtggcggaattaatctacaagatcactcttattaaaaaggacgaataatattcgccctaccgatgtggtttactcaatttataccttcatttgcagtctaattgcatcagcaaccaattagcttttgcacctaatgcttttaactgattttattcaacactttcacattatcaaaccctttctctcgaagatatagagcctgtaacttactcatcacccctcgttcacaataaagaacataatttttactttgatctaattcagcgaaatgtgaagataatttataaaaaggcattaaaataatattctgtcctgagatttccagcggtttatcatcgacttcctccggactgcgaatatctaaaatcacgtcattagccgataaaaccgttatttcatcaacttcaaatacttctttttttgtttgttcggcaatttgacgaatatctaaatattgtgcatttttcaccgcactttccagcacggaaaaatcaaaataactttcttcctgttcgattttttcttttacagcttttactgtcggacttttagaaatgacaccgcaaaattcaggcatagatttagcaatgtcctctgtaccaatttcttttgccttagcaataatttgttctttgtcatgcgtaattaacgggcgtaaaactaaactttcagccacctcatcaattaagcgtaaattagttaatgtttgactcgacacttgtcccagtgcttcccccgttacaatcgcttgaatgccgaaacgttgtgcaactttacttgccgcacgcaccatcatacgttttaacacaacacccatttgtccgttatctactttttctaaaatttccgcaacaacctgttcaaaattaatagcaacaaatcgcactttatgcgaaccgctaaaacgcttccaaatatgatacgccatttgtttcacgccaatttcatgagttgctccgcctaaattgaaaaagcaataatgtactctcgagccacgacgaattaacatgtagctggatacaccggaatcaaatccaccggaaataagcgataaaacatcttcttgtgtaccgataggataaccaccaatcccctgatgacgagctttaatcaacatcattttgtcattttcaatatcaattctgacggtaacatccggtttgctcaactgcacttttgcacttgcaacggcttgatttaaacctccgccaatataacgttcagcatccaatgaactaaaatcatgttttcctttgcgttttactcgtacacaaaatgttttattctcaatctgagttgctacatcactcaaagtttgctcaaaaatatcgtgcaatgtgacaaaaggtttttcttccacttctaagaaatgatgtattccgggaatacgtccgagtaattcaaccaatagtatccggttttctatattcttcgaccgcacttcgatgtaatcccaatgtttaactactgcaacagtatcatcatatttatttaatacattgcgaatattaccagttagaattttcacgaaacgtttacgtacgctttcgcttttaatcataatttcaggaaaaagtttaataataaatttcataatgagtttacatagctttaatttgatgattttcagcacacgtttcgcatactgaattgccttaagtttcgtgacatattagcattcatgccaaatgatataaattaatttttcatttgctatataattttattcataaaatacagtacaatagacaccctgatttaagatgaagcaaggatgattaatatggcacagacacttgacaaaaatgcaactgatgaactcaactttgaaacaaccctcgctcaacttgagtctgttgttcatgtactggaaaatggcgatcttgctcttgaagacgcattgaaagagtttgagcggggtattcaattggctcaagccggtcaacagcgtttgcaacaagctgaacaacgcattcaaattttattgcaaaaaagtgaaaatgcagaattaagcgattatcaaccaagtgaataaaatagttagtttctaatgtatcaatttgctcaagatctccaagaatccaaacaacgaattaatttttttttagaaaaacaattcgagtgcattgatagttctccatctcctttagctgaggcgatgaaatatggattattgttaggtggaaaacgtattcgcccctttttagtttatgcaacaggaaaaatgctcggagcgaatttaattcatttagattatgcagcagcggctattgaagctattcatgcttactcactcattcatgatgatcttccggctatggataatgattcactccgtcgtggacacccaacttgccatattgcctttgatcatgctaccgctattcttgccggcgatgctttacaaccttttgcttttgagctgttaactcaaacacccgatttgtctgccgaacaaaaattagctttagttcaaactttagccaatgcttccggtgttaaaggtatgtgtttagggcaaagtttagatttaatctcagagaatcaacaaattaatttatccgcacttgaaaagatacatcgcaataaaacaggagccttgttgtcagctgcagtgaagatggggtttatttgttctccgcactttgcaaatataaaattagaagaacaattaatgcactactcctctgctgtgggtttagcttttcaggtacaagatgatattttagatattgaaggtgaaagtatagtgattggaaaaactgccggatctgatctccttgccgataaaagtacttatccaaaacttataggtttagatggtgcaaaacagaaggcacaagaactttatcatcaagcactacaagaattggatgctttgccttttgacacttcagcattacatgcactcgctgagtttgtcgtaaatcgacaaagctaagtgcggttaaaataaaaatggaataacgaataatgaataaatatccacttctctctctaattaattcacctgatgatctgcgattattaagtaaagacaaattaccgcaactttgtcaagagttacgtagttatttattagaaagtgtaagccaaagcagtgggcatctagcctcaggtcttggcacagttgaattaactgtagctttacattatgtattcaaaacacctttcgatcagttactttgggatgtagggcatcaagcctatccacacaaaatccttaccggccgtcgagataaaatgtcaaccattcgtcaaaaaggcggattacatccatttccttggcgtgaagaaagtgaatttgatgtgttaagtgttggacattcatccacatctatcagtgcaggtctcggcattgcgattgctgcacagaaagaaaatctcggacgtaaaacaatttgtgtaatcggtgatggtgcaattactgcaggtatggcatttgaagcattaaatcatgcaggctccgtacatacagatatgttagttattttaaatgataatgaaatgtcaatttcagaaaatgtgggggcattaaataatcatctggctcgcttattaagcggttcaatttattctactttgcgtgaaagcggtaaaaaaattctttcgggacttccgccgattaaagagtttgtcaaaaaaaccgaagaacatgtcaaaggtttcgtttccccagtgggaaccctgtttgaacaactcggttttaattatattggacctattgatgggcataatatccatgaactcatatcgactttaaaaaacatgcaatcattgagcggtccgcaattcttacatatcaaaacgaaaaaagggaaaggctatgctccggcagaaaaagatcctattggctttcatggagtacctaaatttgatcataaattaggggaattacctaaatcctcaacgacaccaacttactcacagatttttggcagttggttatgtgaaattgcagcacaagatgaaaaactgatcggtattacgccagctatgcgtgaaggctccggcatggttgagttttcgcaacaatttccacagcaatattttgatgtggcaatcgcagaacaacatgcggtaacttttgccgccggtttggcaattgcaggctacaaacctgttgtagccatttattcaacgttcttacaacgagcctatgatcaacttattcacgatgttgccatccaaaacctacccgtgctatttgctattgatcgtgccggcatagtaggtgcagatggacagactcatcaaggtgcattcgatttaagttttatgcgttgtattcctaacttggtgattatgacaccaagcaatgaaaatgaatgtcgtcaaatgctctataccggttataaatgtggaaaacctgctgctgtacgttatccacgaggcaatgcaatcggtgttaagttagaaccgcttgcagaactaccattgggtaaatcaaagctgattagacaaggtaaaaatattgctattttaaactttggtactttattgtcagaagcaacaaaagttgctgaagatcttgatgcaaccgttgttgatatgcgttttgttaaacctttggatactcaacgtattcaagaaattgcacaaactcattctttaattgttaccttagaggagaatgcaattcagggtggagccggaagtgcggtagctgaaactttatatcagcagcaacaaaaagtttcattattgcaattggggctaccggataactttatccctcaaggtacacaaaaagaaatgctggctgagttaaaattaaatgctgaagggatttttgaacaaataaaacaatttttgcaaaaaatttaatatttttatgaactattttttatgttgatagtcttatagatcgctagtgcactgcaattgcagttgtctttttaatgttaaagtttcttatattaagacctccccgctattcaatctttgaatagcggttttttcttttttaacactcaacagctataaaagagcggtgatttttacaagtaatctgtaattggacttgactgataaccttaatgtggtaaaacaacgctttcaagtattttggaaggaagatgaatatgtatgaaggactgcttattgtattggttccaatgttcattggatatttaatcaaaacaaaaaataccgcacttttaacacgcataaatcatattatgatgatattgttatatatgatcttattcgtgatgggattttctctaggtcaattggatgatttagcgaaacaactaccgataattggtatctccgcctttacttttgcgttaactattcaaagttgcaatattatggggctgttaatttacgataaattaaatcccagtccattaccccatctcgccaaagaaatgccttctcgttggaaattacttcttgacagtgcgaaactttgtgcaatggtgttattaggctttgtgatcggtttatcggtaaaaagttggtttatgttaaaatttggtgcaagcacttatattctaataactttaatttttttcgtcggattacaattgcgtaataatggtatctccttaaaagaagtcttctttaataaacgtggactttatacaggtattatcttcgtttttacttcgttgttaggcggaattctttctgcttatattctcgacttgcctattacacaaggacttgccatttcttcgggatttggttggtattctttatccagcgtaatcattaataatgcttggggacccgtttttagtagcattgcttttttaaatgatttatcaagagaaataaccagcttatttattattcctttattgatgctaaactaccgctctaccgcagtaggtatttctggagcaacatcgctggattgtactcttcctattatccaacgttccggaggaattgaagttgtaccgttagcgattagttttggttttatcactaatattcttccccctattttattggtctttttttcctccatcccaatttagctaaaacgagagtaagacgataaaagtctcactctcgttttataagataaaatcatttttcatataattactcgactgctccgataagttaggaaaataattgttggctatttatatttatattcatcttgatagaataaacgagttaacagtaactttgatatcttatgtgggaattagttaatatgatgaataaaaaaaatagttatagttacgaagatttgttagcttctggaagaggtgaattatttggtgaaaaaggacctcagctaccagccccccagtatgttaatgatggatcgtgttgtagaaatgaatgaggaaggaggattgttcaataaaggctatgttgaagctgaattggatattaacccgaatttgtctttctttggttgtcattttatcggtgatccggtcatgcctggctgcttaggtttggacgctatgtggcaattagttggattttatcttggttggataggcggtcaaggaaagggacgtgccttgggtgtaggagaagtaaaatttaccggtcaaattttacctacggctaaaaaagttatttatcgtattaatatgaaacgtgtaatcaatcgtaaattagtcatgggaatggcggacggcgaagttgaagttgacggtaaagtcatttacacggcaactgatttaaaagtaggattatttcaagacacctcaacgttttgattaaataattgctattgtgttaaaaaattgtagtttctgcgaattttacatttatagagttatctagtttaaaaaagtgcggttatttttattaaataaccgcacttttcttattacttcaattcaccacaattcaaacaatataagtattgccctttgggatcattaaatttatttaaaatacctaattgctcagtcattttctgcattgatgtagaaaagccgaataaatgggcaatatactgacgaagattatgttctgaatgttgtttagcatttttcatcaactcccccaataatgacggttctttttccgttagccaaacaacagaaaaatcttttatttcttctgaagatttctgtatcactaattctctagctttttcgactgcatcatcaaaactgcccagttgatctaccagtttatacgtataagcatcaaaacctgaccaaacttgaccttgagcaattttatcaacttgtgtttttgataaattacgcccacggctaacaacatccaaaaattgatcataaccatgctctatttccaattgaataatctcactgctgattttagataacgggctgaaatgtgatttcatcaccacatcagttgtcgcaacaccatcggcattcacaccaattttttgcatagatttttcaaacgttggaaacatggcaaaaataccgatagaccctgtaattgtattagggtcagcaacaatataatctgccgttgaggaaatccaataaccgccggaagccgccattgcccccatcgaaacaacgactggctttcctgatttttgtaaattatctacttcttggcgaataatttctgaagcgaacgcacttccacccggactatttactcgcaatacaaccgcttttatatttggatcatcattcgcctcacgtaataattgtgctatgctatctccgcccacattttgttcatcactttcaccatcgacaatcgccccttcaacatttaccacggcaatagcaggttgtgtaggttgtgcaaatcgatttttcaatattgccaaataatcctcaaattcaacaaaatccaacttatcatcagaattaactatccaacgtttaatgattttttctcgttcttgcgttaccgctaattctgttattaaaccacgctttttcgcatattcagtctgatttccgttcagtgcttttaattcgctaaggtatgttttactatctggtaacacctgtgctaatggaatatcacgattttcagccacaatttgctgataacttttccataattggttaagccaacggcttgtattttcacgacttttttctgacattttatcgagcataaacggttctaccgcagatttataagtacctacacgaaaaatatgcggtgtaatttccaatttcttaaatagcgatttaaaatacaaattctctacaaccataccttctatcgccacttcaccttgtggatttaacaaaataacatccgcataacttgccaataaatattgactttgcgtatagttatccgcataagcaatcactggtttcttgctggctttaaaggcttgaatagctttcccaatgtaagttaacgcaggaatatctttcccatcaaaataattgagatcaagaacaagtgcggtaatttttggatcttttttagccgcttgaatggcattaacaacatcaaacgttgagatttttctcggtacatgttgattacctaattccaaaagaagctcttgccatgccgtatcatcgctacgattatctgccaaatagccgtccaaatttaatagcaacgcccctttaaaatgagttaaatctactttattcgacatactcgaattaaccgaaaacactgctacaatcaataaaacgaaaaaaagaaatactatattcattacaacacgacgagcaaaattgagcatttgccagcacaatttgagaaaggtcaacatcactttcatattatcctttactaagttaaaacaaatgtcgtaccttaccacaatttccttttacttcatatcgatcaaggtaaaaatatgctagaatccaccgcacttttaagatgaaaaacaagatggaactaaaatggacgctctacaacttcttaccactcgtcattcagaaaaaaaattaatttcacctgctccaactcggcaacaacttgaacaaatttttcacgctgcactgcatacaccggatcatggaaaattacacccctatcgttttgttgttatagaaaaggaagggttgaataaatttacagagttactaaaagaagctgttttggaattagatcttggacaagagcggttaaaaaaagccgagaatttatcccaaagagcacctatgatcatcggtgtaattgccaaaataaatcctgatattgaaaaaataccggcatgggaacaaatgattaccgcaggttgtgctgcttacgctatgcaattagccgcaaatgcacaagggtttgataatgtttggatcagcggtccttgggttaaaggctctgctttgcgtcaagcctttgattgtgaaaaaaatgataaaatcattgcattattgatgcttggtacagcagaacaaaaaagtgatcgaggaaatcgagaattgaatttagataagtttgtgcgttatttatagattttatgtagcccaaattttcactgggctaaaatctccccttataattaaaaaataaatataactcatttttttaacaaggttaaaaactcttttctggtttctctgtcgtccaaaaatactccgcctaaagccgatgtcacagtgtaactattggtatctttaattccacggcattttacgcaaaaatgcgtagctttaacataaacggctacatcttccgtttctaaaatggtttggaatgccaacaaaatttgttgagttagacgttcctgaacttgaggacgttgtgcaaaaaaagcaacaacacgattaattttagataaaccgatcacccatttttgcgggtaataagctactgatactttaccatcaatagttacaaaatgatgttcacaagtactggttaaagtcacatcatcaactagcaccatttcacttactttcatgcggttttcaatattagtaattttagggaaattagcgtaatctaaaccactaaaaatctcatcaataaacatttttgataaacgtgccggtgtttcctccaaactgtcatcagataaatctaaaccaatcagttttataacctcacgcatatgttgttcaataccttgacgacgttgatctttatcttgcataagatcaatcattggtgtttcaattcctttttcaaccaaagcattacgaaccttaatcgcttccggagataaattgctcatgactacttcccgtaaaatcgttatatcctttaaaaatgcctgacattctagcaaataaaagctgaaatctctatttattaggtataacaattactgaatttaaagtaaaatgtgagctgttttttcacattattacaaggatttctatgctatctcttgaacaagctttacagcaaatgctttcgcaattagcaactataaataaaactgaaacgctaacattggaacaagcagtggctcgcatttgtgcagaggatattatttcaccgattaatgtaccgtcttttgataattctgcaatggacggttatgcagtacgtttggcagatttgaaacattcaacaacgctatctatatgcgggaaatctttcgctggtaatccattcaacgagcaatggcaagaaaaaagtgttattcgaattatgaccggagcaatgcttcctgaaggtactgatgccgttgtaatgcaagaaaatgttacaataaacgaagacggcacagttaccatcaatgaaatacctaaattgcaccaaaacattcgtcgtttaggagaagatataaaagtgggtgatattgcattaaaaatgggctcaaaattgaccgcacgttcactcccgcttttagcttctttaggcatctctcacgtaaaagtttataagaaacccaaagttgctctattttcaacgggcgatgagcttgtatccgttggacagcctttagtacaaggaaaaatttacgatagcaatcgctttacaattcgattaatgctggaaaaatttccttgtgacatcttagattttggtattcttcccgatgatgaacaacttttcgagcaaactttctttaaggctcaaaaacaggctgatttagtgataagtagcggtggagtttctgttggagaggctgattttaccaaagctgtcttagaaaagtgcggtgaaattaatttctggaaaattgcaatgaaaccgggcaagccttttgctttcggtaaattaaataacgcttggttttgcggactgcccggcaatccggtttcagctttagtgacgttctatcaacttgtgcagcccgtaatagcaaaattaagtggctatacacaatggaaaatgccacaacaattaaaagcaatcagtgctacaaaattgaaaaaatctgttggtcggattgattttcagcgtggtttttaccaactcaatacacaagggcaaattgaagtttatcctgtcggacaacaaggttctcatctttttagtgcctttgtgaacagtaactgttttattcgtttggaacaagaacgtggaaatgtcgaagccggtagcatcgttactatagaaccttttagtgatattttaaactaggatttttatgcaaatcgaactctcaacaatagaagaattacgctataaccgtcaaattatcatgaaacaaattgattttgatggtcaagaaaagttaaaaggcacaaaaatgcttattgtcggcttgggaggattgggttgtgctgctgctcagtatcttgcttgcacaggtgtagggcatttaactctccttgattttgatactgtttctctctctaatttacaacgccaagtactgcataatgatgagcgtttaaatatgctcaaagtacaatctgctaaaatcgccctgcaacaactgaatcctcatattgaaattcaatgtattgcagaaaaattgaacgaagaaaaacttgctgaaattgtaccgcactttgatgcagtcttagactgtactgataatgtagaaatccgtaatcagctagatcgctgttgtttggctacaaaaacgcctttagtatcaggtgcggcaattcgtatggaagggcaagtttcggtgtttacttatgaagaaaatacaccaacttaccaacatttaagccgtctattcggtgaaaatacgctaagttgtgtggaagcaggtgttttatctccaatagtcggcattgtaggggcaattcaagccttggaagcaataaaagtgcggttaaatataggcaaaattttatcaggacgtttattgatgattgatggtttaaatatgaagatacgtgaaattaacattccgtctgaataaaaactcaatatccttacaatctctaagataatgctggattgcctaaaacacaggtttatcaatcaactgttttcaaagtagcaaagattcaggtagcacgccattatctccacgatgtacccgcataccttcaacccgcacacgtcccgtcacacaatcagctatggcttttggtaacaaacggtgttctgctgctaaaactcgtgccgccaatgtttccggtgaatcatcatcggccacaggcacagccgcctgtgcgataatcggtccgcaatccatctctgccgttacaaaatgcaccgtacacccaactacacgacatcctgcctccaatgcccgacgatgcgtatccaaaccagtaaatgcgggcaataacgatgggtgaatattaatcagcctcccagcataatgcgtgcaaaattctggcgtaagtatcctcataaagcctgctaaaacaacccaatcaggctggtattcatcgatttttctcatcaaagccgcatcaaaatcgctacgttcaggataatctttgtgactgaccacaccggtagcaataccttgttcttccgcccatgccaaaccagcagcatcagctttattagccaataccgccaccacatttgcaccctcaattcgagcttcaactacagcctgcatattactgccacgccctgaaattagaattacaatgttttgagtgttcatttttttccttcaatttttccttcaatcaaccctgccgggattaattgctttgttgagatggcacaaacatcgttttaatcaccgcaacttcagattccccctaaattttatcaacccgtccgattcgaaaaagattctaagtacgaacaacaaagatggtgaagaatatggattggggtagcccttaaaaggctatggctctatggctatggctatttgctattctccacccatttaccatcaacaaaataggcactccattttgttgttttaccatttttctctgaggtaacatattgacgtttttctttacgactaaagcgaataattgcctcattaccttcaggatctttaactggcgcatcagctaaatagcgtaatttttccggcaggcgatcttgatattgagccaattcagccacttttgcaggacgactttctcgtgattttggaaaattatgtgctgacataaacacaccactcgccccatcacgcaatacaaaataagcatccgatttttcacattttaattcaggaaaatgtacaggatcctcttttggcggtgccacttccccactttttaaaatcttccgagtattatcacaattcgtgcagcccatgtatttaccgaaacgtcctaattttaagtgcatttcaccaccgcacttatcgcattcaactataggaccttcatagcctttaattttatattcaccttgttcgaccaaatagccattgcaatttggattattcccacaaatatgcaattttcttgtcgtatcaatcaaataactgtccattgcagtatcacatttcgaacaacgcttacgttccattaaggcttttgtttcagagctttcatctaaaacatttaataattccgcttccggaattaaatttattgtggttttgcaccgctctttgggcggtaaggcataaccggaacagcccaaaaaaacaccggtactggcagtacgaatagccatttggcggttacaagttgggcaacctatatctgttgcaaccaaactatttggtttcattcctccgtccaattcatccaattcagcttgtgttaattgttggctaaaatctttaaaaaattgatttaattcttctttccaatttttcttaccgtctgcaatttggtcaagtatattttccatattagcagtaaaatcatagctcattaaatcagcaaacgattggttcaatcgatctgtgacaatttcccccattttttctgcataaaaacggcgattttcaactcgaacatagcccctttcttgaattgtggaaataattgcggcataagtagaaggacgaccaatccctcgtttttccaattctttaactaaggcagcttcactaaaacgtgctggtggtttggtgaaatattgttgaggttcaaccttagttaaacttaatttctctccaactttcactatcggcaactcttgatcttcagggtttctattcgattgaggtaatacttttgtccaaccatcaaagcgtaaaacacgtcctttcgccttcaattcataatccccagactgcacggttacggttgtgctatcatatttagcggctggcatttgacaagcaacgaattgtcgccaaatcagatcatataaacgcacagcatctctttccattccctctaaactgtcagccaattgttttacatcggaaggacggattgcctcatgtgcttcttgtgcattttctttactggaatagaaattcggtttgtccggtaaataggcttgtccaaattcttgcacaatataattacgcaccatttctaaggcatctttacttaaatttgtgctatctgtacgcatataagtaatgtaacccgcttcatataaacgttgtgctaacatcatcgttttctttacgccaaaacctaattttgtgctggcactttgctgtaaagttgaagtaataaaaggagcttttggttttgacgtcgttggttttatttcaagatctttgacgaaataatcggaaatttgtaaaaaatctaccgcacttctcgcctgttcgatatttttaggttcaaattttttcccttgaaattgtactacatctaaacgaatagatcgtttttgactgtttttactatcaacagaaatttcccaatattcttgaggttgaaaagccttaatttcacgctcacgctcaacgactaattttactgccacagattgaactcgaccggcagatagacctcgtgccacttttttccaaagtaacggtgataccataaaacccactacacgatctaaaaagcgacgagtctgttgtgcattaacacgatccaaatttaactgttcagggttctcaaaagcttgtttaatcgcatttttagtaatctcattaaatactactcgactaaaacgactgtcttcaccgccaataacttcgcgtaaatgccaagctatcgcctctccttctctatccaaatcggtagcgagataaatatgatcaactttttttgctaaagatttgagttcagaaaccactttctctttaccgggtaaaatttgatacttagcttcccaattatgataaggatcaatccccattctttttaccaacgcattttgctctttttccgtttttatgcgttgtttttcttccgcacttaatcccttcgttgaaataggtttcgctttttcaccgctactttcacctaccgtaggcagatcacgaatatgccctacactggacttaactacatattgattacccaaatacttattaatagttttcgcttttgccggcgactcaacaattactaaggatttactcatatttttatttacctaattcgctgtatttttgtaaaattgcccgctatattgcttactatcttttgcaaggtcaacagttttttataaaaatgggtataaatgaataaactaaatgcagtttcaatcatctgtaaggttattaaaatatacagaactcttaaagctacaacgtaacaaagcatttaccccatcatgtttacgctaaactaaaagcattgattcattttgttatcagcttatatttgtactaaacgacacgctaaaaataaggtaagttaccttattttccctcacttccccagcgaagaaataaatcttgttctaattcaataccaaattgatcacatacacgattgacgctttggttaataatatcatctaagttactgggtttatggtaaaaagcaggcattagaggggtaatctgtgcacctatttctgccgcctgagtcatcaaacgtaaatgtcctaagtgtaaaggtgtttcacgtacacataataccaacggtttacgttcttttaagcatacatcagcagctcttgtcattaaatcatcggtatagctatgtgcaatacctgacagggtttttattgaacaaggcaaaattaccatgcctaaagtgcggtaagatccggaagaaattgccgcactaatgtcccgaatatcataaactttatcggacaattctcggacttgttgtaccgtaaattgtgtttcaagtgcaatagtctgtttcgccgcttggctaataataaggtgcgtttcaatttccggaagggattttaaaatttgcaacaaccgaatagcataaatggcaccagatgcaccggtgatgccaataattaaacagtcttttttaagcttcattgtgcatttcgagattcgtggcatctttttcacgctttttctttgctttgtcattacgtaaatcggcaacttgatccaaatacgctgaggtaatatctccagtaacataaacaccggtaaagacagaacaatcaaaatctttaattgctggattttcttgctgaacagctctagttaaagcatcaagatcttggaatataagtttatccacaccaatgagtttagcaatttcatgaacatctcgtccataagcaattaattcatttttagtaggcatatcaataccatacacatttggataacgaatttccggtgctgctgaggcaaaatagatcttatttgctcctgctgctcttgccatatcgacaatctgtttcgaagtcgtccctcgcacaatagagtcgtcaaccaacaacacattcttacctttaaattcagaagagatggtattgagcttacgacgtaccgcacttacacgctgagtttgccccggcataataaaggttcttcccacatagcgatttttcacaaaaccttgtcgataaggtttatttaaaatatgtgcaatttgtaacgcaatatcattggacgtttcaggaatgggaatcacaacatcaatatctaaatctttccattcttttgcaattttttgtcctaagttttctcccatgtgaacacgagccgcataaacggagacaccatcaatataagaatccggacgagcgaaataaacatattcaaagatacaaggcgttaacttaggattttctgcacattgttgtgcatataactgaccatcaaaagtaacataaacggcttctcccggtgctacatcacgaacaaattcaaagtcagcaatatctaacgcgatactttcagaagcaaacatatactctgttttaccgcttacctcatcttcacgttttcctaatactaacggacgaataccatttggatcacgaaatgcaactatgccataaccaatcatcattgcaacacaagcataagcaccacgaatatctttgtgagtagctctaactgcctcaaaaatatcctgcgtagataaagggtgtgttgtttgatccaaatgatgagccaaaatatttaacaaaatttccgaatccgaattggtattgacatgacggcgagcaaaggtaaagagtttttgttttaactcttctgaatttgttaaatttccgttatgcaccaaagttaaaccgtaaggtgaatttacataaaatggttgagcttcagagacactggaacttccggcagtaggataacgcacatgaccaactcccgcattcccttgtaaacgtagcatgtgaacttgctgaaagacatcacttaccaatccatttgcttttcgtaagcgaaaacgattttcttcatctactgtgataatcccagccgcatcttgcccccgatgttgcaataccgtcaaggcattataaatagactgatttacagggctatggctaacaatacccacaattccgcacatatttcacgttccttatttattcaatgttgaatttattaaatttgaatttgcttgtatttgttcaaaaaaccattccacaataaagccaaagtgcggtattaattttgatgttttccaccaatcactctgtgcaaagtttgtgaaagaatcaataaaaaatagcaatgccgccacgattaatatacctcgtagcaacccaaagcaagcacctaataccctatctgttccggttaaacctgttttatcaactaactgactgataatgtagttaagcattgcaccaacaatcaaagttgctacaaataagattgcaatagcaaccgcattacgaacataaggtgcttctatttgagttaaataagttgctaaatagggataaaaattatttgccaccaaaaaagcaacaatccagctggcaagcgacataacttcacgcacaaacccacgcaataaactgataattatagagaataaaattattccgataatcattaaatcaagataattgttcattaggtaacctctaaaatcccatcaatttaagaccgcacttattctagcaaaaaaggaaaacgtttgcgtagtctaaattcacgctttatgcaaatttaatcgaaataaaaaagaagaaatcagaattgtcgtctaaaaatatagatggaaatatcaggaaatgtatcctttcagtttaaaatccatctgtctattcactaaaacactagatgagagatgttgagttagtcgataagccgggttctgtcttggacaatcattcatctaggcgtacatttacacatacgctcaagcaacctacccgaactctgagcgggcaactcattgagttcctatttggtcttgctacgagtggagtttaccatgccataaaatgttaccattcatgcggtgtgctcttaccacaccctttcacccttacctgatctcttacgagccattggcggtctgctctctgttgcactggtcgtaggctcacgcctcccggacgttatccggcactctgccctatgtagcccggactttcctctcgtttacttatgcctctaagtcgtttaaaaacggttaaagatttcaacaaaccagcgattgcctgactaactcgatgcggagtatagcgtaaaattcagataaaatatagagttcacccaaaacttgcggtaaaataaccgcacttttcaatgaggaaatgacgatgaattacttacaaatcgctcgaaattcgttagctgccgagcaaaatgctttagctaaacttagtcaaaatttaaatcaacagtttaatcaggttgttgagcttattttaaattgtgaaggacgattagttgttggcggaatcgggaaatccggacttattggtaaaaaaatggttgctacatttgcctcaacaggaacaccaagtttttttctacatccaacagaggcttttcatggtgatttaggtatgttaaaacctattgacattgtgatgttaatctcttatagcggtgaaagtgacgatgttaataaattgattcccagcttaaaaaattttggcaataaaatcattgcattaacaggtaacctaaattctactttagcaaaacatgccgactatatccttgatattagtgttgagcgtgaagcttgtcccaataatctggctccaacaacttcggctttagtaacgttagctttaggcgacgctcttgcggtttctttaattacagccagaaactttcaaccggctgattttgccaaatttcatccaggcggtagtcttggtcgtcgtttgttatgtagagtgaaagatcaaatgcaagttcgtttaccaaaagtaacagaaaacacaaactttactgattgtttaaccgttatgaatgaaggtcgtatgggggttgctcttgtcatggaaaatgaaaatttaaaaggtattattaccgatggcgatattcgccgtgcattaagtgcaaacggaactaatacacttaacaaaacagccaaagatcttatgacttccaatcctaaaactattaactataatacttatctgtctgaagcggaaaactttatgaaagagaaaaaaattcattcattagtcgttgtagatgatcagaataaagtgataggtttagttgaattttcgagttaatcccatgatgttattaaatgaaaaattacaaaaaattaagctggttattaccgatattgatggtgtactaacagacggcttattgcattatgatgccaacggggaagtaatgaaaagtttccatgtgcgtgatggactgggtatctgtatgttaatcaaaaatggcattcaagttgcagtcttatctggtcgagactcccctatcttacgtaaacgcattgcagacttaggcatcaatttatttttcttaggtaaattagaaaaagagagtgcttgttttgaattaatcaaaaaagcaggtgtaacacccgaagaaactgcatacattggtgatgatagcgttgatttacccgcattttccgtttgcggattgtcttttgccgtaaatgatgcgatggactatgtgaaagattgtgctgatcatattttgagtttaccaggggggaaaggtgcctttcgagaaatgtctgatatgattttaaaagctcaaggaaaagcaagtgtctattccacagcacaaggtattctcaaagcagttaacaagatggtgcaataaaatagataatgaaaataacagtccacatacaaaataagcggactgttacttgtctgtaaaatatctctaaacacaactaaaatccccgcaagcaacgtaaaaaatacttttcacattctacccattcattcattaatttaataaccacattatcgatcaccgcacttacataagctaaaccttacatcataattacctattcgtattctaaataacaatagttattattaaaaatacccttttaaattaataacttataaaaaaataaaagttgcattccatgaaaaactgattaaaataaaacctgttttattcatcaataaaaaaggaactcgctatgctaaatcaagctattattactaagttaaatgaacaaattaacttagagttttattcatctaatgtatatttacagatgagttcatggtgtgctcataacggctatgaaggtgcagctgcatttttacttcgacatgcagatgaagaaatgcaacatatgcataaattatttacttatgtaagtgaaacaagtggtatgcctctgttaggtaaaattgaagcacccaaaaatgattacaaatctttaaaagaaatttttgaaataatcttagaacacgaaaaatttgtaactagtaaaatcaatgaattagttgaaattacttttgcaaccaaagactattcaacatttaacttcttacaatggtatgttgcggaacaacatgaagaagaaaaattatttaccggcattattgataaattcaatttgatgggcgaagacggtcgttctctttactttatcgatcgtgatttacttactttataatagataggacaaaaatatgttatcagcaaatgttatcaaattattaaatgatcaaatgaatttagaattttattcttctaacctgtatttacaaatgagtgcttggtgtgagcaaaacggttttgacggaacagctaaatttttagccgcacatgcagtagaagaaatgcaacatatgcgtaagttattcacttatttgaatgaaacaggtgcttcggcaatcattacggctattgatgaaccgccacatgaatttgattcattaaaacaagtaattgaactaacatacgaacatgaaaaactcattacctgcaaaatcaatgaattagtcggaaaaacctttgaagagaaagattattcagctttcaatttcttacaatggtatgtagcagagcaacatgaagaagagaagttatttagtggtattttagataaaattaatcttcttggtgaagatggtaaatgtttatatctaatagataaagacctcggtgatttgacaagtaaagtataatctatagaagatcaaatctaatctgacagtccctgtttaaaattatcatatctgtcagattagtttgagcttaagttttttctatctaagtacattttccatcaagtgatgttgctattaatctctcacttaagcacgtttttgtgggattataataaagctctctttttgagttactatgccttttaccaaaatgagtaaaaaaataatcatttgtagaatcatactaatgacagtttaaaaatatcacttgatagtaattgacaatattcagtagacagtcctttatctgtgataatttgtgtaaagttattaagttgagttgcacaaaataaggaatattttccatatttactgctatcggcaactaatactttttgtttggcattttgttggagcattctttttaaatgagctttctcttctgtaggtgcggtaacacctttttccaaactccaagaattacaacttacaaaagcaatatcaggattaatgttattcaataaaatcaggctatggttaccgatacaggattggctactattatccactcttcccccggttatggtcaattctatttgtttatattcggaaagtaataaagcgatatgcagatcagtcgtaatcactcgaagtggcatatgagcgattttttttgcaatgcacaaagttgtagtacctgcatctaatacaatagagtctcccggagaaatgagagaaacggcatattcggctatccgctctttttcagtaatttgcttaagttgcttttcatttgtagttggttggaatggaataaagtggtttaaacttactcctccgtgtgtacgaattacaacaccttcttcatctaattttattaaatcacggcggatagttgcaggagaagcatcagtaacctttaccagctgttctacggtagcaatattatgactttttagaaatagtaaaatctgctctagacgatttttagacatataaactctcttatttgtaattattttactataaataattttttgaaaataagatagtgaaaattaaagaacctaaaacattattgctttaggttctttagtattatttctccattatgtggcttaaaagtacttcgcttccaaatccaccggatttggtcattacaacgatgtctgaatagttaccttcttcaattaagcataaaggcactcccggtactactgcatataatacgttcatttcagttacattcatttgatccaataatgctgcagccccatctccaccgaatagtataagactatcaaatttttcattatcaaggcagaatttacttaaatcagctaagtgttgagaaatttctttagcggtttcagtaatatttgccgattttgcatttacgacttttgctgggtttgctcgaataatcacattatccttactaaaacgtattagagcgtttaattgtagttttagtgaatgttctgactgcgaatagttcatcaactgcgaaggtgaaggatgaaatacaatcgattttccacctaaagttgaaacatattcatcaacttgaagctggcttgtttcgtggattgatgttactacaattaatgttctacctaatgtaatctctcgctttggtctcggtttattttgaatatttttcaatttctgtgctaatccagctgagccaacaggaataattttatttcctatatggtttataacttttgcaataattgcaagatcttcgtgcgttttagcatcaataacgatctgtttatattcactattttcaatagatgcctgcaaattatcgaccgtatcacacggaattacttgagcatcaggcaataattcttgcatagaggaagacagtacagggcaaataggatctttgcctgaagcagtttcctttacaggaacactattaacatataaatgaccagcttctatcgttctccccatttctggatatgcaggacaaataattgctttaacgtctggatataaactagcccaagcttcaatagcaccttcaatttgatattttacagagcctctcattgtagaatcaattttgaggtaaatttgcccaataccattttggatagcattactaattgcaatttgagtttgtttttttgccttttctccaatagctcttgagtcagtagaaacagaaattacttgagctttatcagattgcatttgtgctaatgccgaaactttagtttttaagacagtgttaaaccctgcttcagcaaacataactgcggtatcatttgcaccggtaagatcatctgcaataactaagagagtttctttcatagcttttccccttttactgtttcttgtgctaatccaccttgacgttttaaaacccaagccgcaaataatggagctaaaacagcggaaactaatacagcagctgcaatttgtgcagtagcagtttgcaccaaaggtgctagtgtaggatctgcttgagcaacaatttcaggtgtaattatggcatttccagcagtagtaccagcagcaaatccaatccctgattgattacctcgtcttaaaatagttttgtaaccgataaacacaaggaaacctgtaaagagagaagctactatacctaaaataatacctgttgctccaccagtaataatggcctgtaagttaatacctgtacctaatgcgaaagcaaagaaagggataacaatagcaccagttggtttcattagttctgtccatttaggatctaagttaccaataaccataccaacaatcagaggaataacagctgcaagcatcaatgagaaaggaatatcagctaatcccgatacacctaaaaatagtaaaacaaagaaaggaccgtcattaactgcagaagcaatataagcccctttatctctataatcgccatattttcctgtaaatgctaaccaaatacccccatttgaattagccacaacagtaagcatagctaataaagaaacccccataacaccatcatttcccacccataatcctaaaaaaacaactaaaagagcgggtataattgttttaaataataatacaatgccggtatgagcaagaacaggaccggaacttctcacagtaatttgcatacctgttgcgaaaattaggagtgcaataagtgagcctgctgatgatttgaataaagctgtcgtaaatgaacctaaattcaaaaagtcaggcaaaaacgtaccaataatagaaccaaaaattagtggtattaccattgccccaccgggaattttattcataccatcatatattggaacgatggatttagatacttgagtagacatattaatctccttagtgtgttgcatatttgatgtttgccatttttgcacctagatagagtgcttcagacatactacggctatcggcaactccctttcctgcaatcggaaatgcagtgccgtgatcgacagatgttcgaataaatggaagaccgacagtaacatttacacctgtatcaaaacctaataatttgatagggatatgtccttgatcgtggtacatcacgacgacaatatcgaactcgtttagattagctgcacgatgaaataaagtatccggtggtataggtcctgtaacattaaatcctttggcttgagctgctagaattgcaggtacgatttctttttgatcttcatcaccaaacattccattttcaccagaatgagggtttaaaccggcaacagcaatacgaggctctttaaagccaagaatacgagcattttcttctgccaaatcaataacagtggcaactcgttctttagtaactaaatcacaagctttacgaagttggacgtgagtagtaacgtgaataacgttgagtttttcgctggttagcatcattgagtaatctttagtattactaagggtagctaaaatttcagtatgaccgggaaacattttaccacttgcatgtaatgcctctttatttaaaggggctgtaacaatagcttggattttcccttccatcgctaacttaacggctttttcgatgtattcataagccgctttaccagcacgaggatcaatttgagcaaaaggcaaatcttctgataagttattcaaatctaaaatatcaataacaccatactctgccgtaaagctatctagatcatttaatattcttaatttcagttctgaatgaacaataggtaaagctcgttgcataattttttgatcgccgataacaactgggtgtgctaactcataaatccgtttatcagccaatgctttaataataacttctgggccgatacctgcggcatctcccatcgtaattcctaaaataggtttcatttccactccttgattgaaattaatcatttttagcaaattatatcgcaaataaagagataaaaatgtgattaaagtcaaaaaatgatcttttttaatcgcattgattttatttaatctaaaggtaagggttataaagcagattagaaaagtaaaatgttatttaatttgaataaacacttccctttttagcaaaaaacggtatcattacgcctcttaaatgtaaccctacatttaagtttgtttccaacctatcctatcttgggacaaatagggtaaaaacaaaaaagctggaacgctttttttaataagtagcgagtcaaatgccccatggcgtctagtctctctggatttgagagcttaggcttcctccgcaaggcacccgacttatttttttcacctcttttagaaggtttatttcaatgacaattaaaacccctgttcaagcaactcttgcttcaaatcaatactttttagatcgccaagatataatggaatcaaacgtgcgtagttacccgcgtaaactgccgtttgcttatcaaaaagcacagggcgtttgggtaactgatgttgaaggtaatgaatacctcgatttcttagctggtgcaggaacgcttgcattaggtcataatcaccctaaattaattcaagcaattaaagatgttttagacagcggtttgccgttacattctttagatattaccactccattaaaagatgcttttaccgaagaattactctctttcttccctaaggataaatacatcttacaatttaccggtccatcaggagcagatgctaatgaagcggcaataaaattagcgaaaacctatacaggtcgtggcaatgtcattgcattctctggaggtttccatggtatgacacacggtgcattatctttaaccggtaacttaggtgcaaaaaatgctgtgcaaggtttaatgcctggtgtgcaattcatgccttatccacacgaataccgttgcccatttggtattggcggtgaggctggtgtgaaagcggttgaacattattttgaaaactttattgaagacgtagaaagtggtgtggtaaaaccggcagcagtaattttggaagctattcaaggtgaaggcggtgttgttccggctccaatcagcttcttacaaaaagtacgtgaagtaacccaaaaacacggcattttaatgattgtggatgaagtacaagccggtttctgtcgttcaggaaaaatgtttgcctttgaacatgcaaatattgaacccgacattgtagtaatgtcaaaagcaattggcggtagtttgccattagcggtattagcgattaaaaaagagtttgatgcgtggcaaccggcaggtcatacaggcacattccgtggcaaccaattagcgatggcaacaggctatgtttctctcaaaattatgcgtgaagaaaacttggctcagaacgcaaaagagcggggtgaatacttaactaaagccttaactgaattaagcaaaaagtttccttgtatcgggaatgtgcgaggtaagggtttaatgatgggtattgacattgtggacgaacatcaagccaaagatgcaacaggtgcttacccacgtgattgcgatttagcggtagctattcaaaaatattgttttaaaaacaaattgttactagagcgtggtggtcgtggtggaaatgtggtgcgtgtgctttgtgcagtaaacattacccaagcagaatgcgaggaatttattaaacgctttaagcaatctgtagccgaagctgtgaaagcggtacgtggttaatttttgataaaacaagcggtcatattttgcaaaaaatttgcgaattttgaccgcttgaattgtatatagcattgaatgagataacaaaaatgacagatatttccaaacacagacaatcgctattttgtagcgatccacaatctattgcggattatgaaaccgcaatgaacaatgcggtacaagcggtatcaaattggctaaaaaatgaaaaaatgtacaccggcggttcgatcaagcaaatgcgagccttgattgacggcttcaagccgaccaaagagggagtgggagtgcaaaaatctcttgagcatttggtagagattttcctcaacccaagccttaaagttcaccatccacactctttagctcacttacattgcccgacaatggtgaccagccaaattgcagaagtgttaattaatgcgactaaccaatctatggactcttgggatcaaagccctgcgggatctattatggaagagcatttaatcgactggttacgccaaaaagtcggctatagtgaaggtacagctggggtgtttacttcaggtggtacgcagtcgaatttaatgggcgtattgttagctcgtgactgggcgattgcgaaccattggaaaaatgaagacggctctgaatggtcggtgcaagcgaatggtattcctgctgaggcaatgaaaaacgtgaaagtggtttgctcggaaaatgcccacttttcggtacaaaaaaatatggcgatgatgggaatgggcttccaatcggtagtcactgtgccgtcaaatgccaatgctcaaatggacttagaagcgttagccaaaaccttagcagacttgaaagctgacggtaaaatcgtagcttgtattgtagcaactgcaggcacaacagatgccggtgcgattgatgatttaaaagcaatccgcaaattggcggacgaataccaagcgtggttacacgttgatgctgcttggggaggtgctttattattatcgaaagattttcgtcatttcttagatggaattgaattaaccgactcaatcacgctcgacttccacaaacatttcttccaatccatttcttgtggggcattcttgttaaaagacgaggcgaattatcgtttcattgattacaaggcagattacctcaactcagaatatgacgaagaacatggtgtaccaaacttagtagcaaaatcactgcaaacaactcgtcgttttgatgcgttaaaattatggtttacggtagaagccttgggtgaaaatctgtatgcttcaatgattgatcacggtgtgtatttatcaaaagaggttgaggcttacattactgcaaccgaaggcttggaaatgttagtacctgcacaatttgcctcagtgctgttccgtgttgtaccgaaaggctatccggcagaatttgtggatacattgaaccaaaacgtggctgatgagctgtttgctcgtggtgaagcgaatattggtgtcacgaaagtcggcaacaagcaatcactgaaaatgacaaccttaagcccgattgctactcttgaaaatgtgaaagccttattagcacaagtgttggcagaatcagaacgcatcaaagattctattgtaaacggcacctatatcccgcctattgattaaacgattggcaaaattatacctaaatcagaccgcttatcagccttgaattgattaatgagcggtcaattttttaactttttacaaattttattgaaagttctattgttcataacaagttaatcaaccattaatttcctcaatacttcacttaacccactttgacgctctgtcgctttacccaccgccatattccatattttgcggtcggaaaaaatagtaacttgattgattgctcttgttactccagtataaaccagttctttacataaaacaggattggcttcacaaggcaaaaccacaaaggtatgggaaaattctgaaccttgggatttatgaatagtcatggtaaatgctggactatgctcaggaatacgacttgctaattcagccttaccattttcaaaccaaaaatgcccttttaagctaccatcaggttgtttttctgctaaatacaacgcaatatcaccattagccagtccgagacggctattattttcagtaataatgattggttttccgatataaaaatcacgactatgattaaattgcacaagtcctttttgctttaattgttctgcaataagttgattgagattttcgctccccaattctcctaccctaagtgcggtcaaaaatctcactttattgaatgcagcaaaaatatccgcaatatgcggtttaatcggtaagttattttcaataattttgtgaataagctgtaaatattctgcataattttgtaccgcactttgcacgaccaattgactgcaatattgagaataatggtgtgctaatggctgttcatcaatattagtttgttcatattgtgtagaataatccactaaattgatttctcccgtgtcgtttgtgttattttcttgttgatattgatgaaataattgccaactttcagcaattttttgttggttaattaattgagctaatttaccaatataaggatgtttaccgaaacgacgactgccctctaagttgcataaacaatcacgaataagattttcatctgcatgatgttctaagttttcccctgttgtttgctgtaaataatctgctaactttgaactaattgaatattgtctaaaagtacccaattcagccaaaatcgctcctgcttcaacagaggataactgatccttatcgccaagcaaaatcagcttacaactcggtttcaaggcttgtaataatttcgccattagaaacaaatccaccatagatgcttcatctaccaccaagagatctatcggtagtggattacgtttattatatttcgtcttttcttcaaaaaatcgcacaccaattaaactatgaatagtttcagcattaaaaggaatagcattttttatatgttcactaactttaattaactccttttttgtcaataaattaaaggaatttttcatactaatttttaagcgttctgaagcttttccggttggggcaactaggcgaataactaattttccctctgccaactcctgtaatgccaataataatcgagtaactgttgtcgttttacctgttccgggtccacctgtaatcatgcaaaaaggttgatgaattgccgttgctacagcaattttctgccaattatgcttttgttttaaactattatcttcatgctctaccggaaagtatttttgtaaaatgccttgaattttttctatcggatatggttgattttctttctgttttattgttcgaattaaaaattcggcaattcgatgctcatcttgccatgtgcgataaaaatataggcgattattttgtagcaccaagggctttacctcattaataggatcttgagtaaatgcgatatgattaatgagtaaattttgccattcagattgtgtaatattccctattttctctttaatatcaataaggtaacttttttccgcataaggtaaattaaacagatttctaaaagaaaaattttctatttttaagcacgtatgtccttgttggttatgaaaattacaaagtgcggcaagtaaaatagctaaatttttaacttgtgatgaataatctaattcccgttgtttatctgcaatcaactttgcaaaataataatcaccagcttgaataaatttcctttccttaagttgatacaaaatatttagcattaaaataaactctccaattcagaaatcaaacgccaatccggtttatcaaaaaatatcccggaattatcttttccattcattccacgtaaaaaagtataaagtacaccgccgaaatcacgttggtaatcataatttttatcccgctcttttaaataacgatgtaatgcaatggtataaattaaatactgccaatcataatgattattacacatcacttgaattagattgtcttgctgataatgttgagaagaatagcctagtaaattagacttataatctaataagtaatacttgccttcaaaacgaacgaccaaatcaataaaacctctcaccatacctttaattctatccatcagtatcggtgatgacggtaaatgatgatacttacttaacagccgattaaagacattttcattaaatgattgatttaatttcaaataaaattgcatttcttttaaacaatcttgcgacttgatattgcctaaagtaaagcctgcaatatcctgttttaaaggcgtattaaaaatcgcatttatccattttttcaatggattttgccattcatcacttaattgtaacgtctgacaaagtttagataattggtcatcattcaatgcctgcgtcatattatatttttcaaaataacgatggaattcgctaccaacatggacaccatgaggaaaatcaaacggtgaaaaacctacaggataatcagagtctgcactcaactttatatcaaatgacgctgacatatcatgaccattttctctcacatcatgatctcttgcttgatcaaaaactccggatatttcaatctgctgtgctttttgtcgagaatttaaagatctgttacgttgatgacggtaggtcatttcagtaaaacttgttacagtccaattacgctcaatcttgccatgaaattcttccgcttcaaccggcgacaatgcctgttgcactgtaatatactcatttctccttactaatagttttttatcttcctctatttcaacacattgttcacctaattcctcaattattggacttaacaatttttttgcatcatattcatcatcaattcttttatttgcaccaatttgtcccttagttaatacataaagtaacgcattccattttttctcaaaaatgcgaggaaaattaataacaatctgatatttcgctcgagtaagtgcgacatagagtaaacggatatcttcagccatacgctctttttcaatttcatcggaatgttgcttatccatatcccataacacttgttcttgattttcatcataataagtattaatggcattatctcggaatagggacggcttacaaataaaaggaatccaaactaaatcataagcaagccctttagatttatgtaatgtaacaatcttgactaattctcgatcactttctaaccgaatttgttcttccaagcgttcttcgccttgaatctgtttctcaaaccaacgaactaaggaggactcggtatcatttaaacgggtagcctgttgcaataactcacttaaatgccacaaatcagtcatttttctctcaccttgttccatcatttgtaaattttcattaattttttcaactgcaaataaatgatgcaacataggtaaaataccctgcctttgccattgttgttggtaagcaataaatcgctcaacacagttttcccataagttctcatcttgcttaatttggaatatttctgcaccggttttagcaaaaagagcggtactcaacgcatttaaaatattattttcatttaacggatttaaacaagctcgtaaaatatgcaacagttcttttgcagtgatactatcaaaaacgttactacgatctgaaagataaactgatgcaatacctttatcccttaaggctttttgtattttctccgcttgagtaaaactactgactaaaactgcaatattttttgcttttagtggtttgttatctaaaatagcttgattttgtaccgcactttgtagccattgctcaatagataaagcacaattttcagcaagttgtgtgtcattgttgtcagtcaaataacctcttaatgcaggttcaattcttccatttaagcaaaatcggttgggaagaagattcccttgagtgtcataatataatcctttagcaacctgttgaaatggaatttttttatgtaaaaaaggagaattttcttgaaaatcaaaaagataatttatcgtctgaataagaggttgtgtagaacgccaattttcgcccaaactaaatcgatattgtgcttgttccgttgctttcagataggtaaaaatatccgcaccacgaaatttataaatagattgtttaggatccccaatcataataaagcccgtatttttcaccgcacttttaatataaatttgataaaaaatatcatattgctgttgatctgtatcctgaaactcatcaatcatagcaaaaggatattgatggcgaataagttgtgctaatttatctccttgtggttgatataaagcattgcgtaccagacgtaaaagatcatcaaaccccttttgttgatgcgtaagtttataatccattattttacgatttaattcatgaacacaatggtataaaagtacagaaaaattatttgaaatttgagtaacttcattggtcactaagttttccaattcggaaaataaatcatgcgatactaaaggttcttttttatctaattccaattgataaaaatattttgccgcctcaggttgctgaatatcctcgttttctgcccatactcgcattttattaaaacgactttcaaaccaatctttacgccatttttttaaagcgacaagctctcttaatgctttttcattttctaaccaacgttgtttaaattgatgaattttactaagttgaggctcaacttgagtatgtaaaaattgctgcagagaaatctccaataagtgcggtttttgggtatttacttttggcggctgagaaagatatttataaacgtaagataccagttgcttcggcgatcctaattttttgaaaatgaagtttgcgactgacaaaggctgatgataaaaattttcacgccatagctcatttgccagacgttgaattagttcagattcatcactcaccagctccatattaaaatgtacccccgaattaaaggcatattgcattaatactcggcgacaaaaactatgaatagtcgaaacggcggaaatatccaaatttcgttctgctaaagttaaacgatagactgcaagatcgatgtctttaatataaggcagtaattcttgcagaaattgatcttcaagtaatgttttattttgatgttgctgatattgaattaacgcttgttttgtttgataaacacgttcccgaatacgttgctttaactcttgtgttgccatttctgtataagttactaccaaaatttgatcaacttccaatgcctgagaaaaattattttctcccgcttgtaataacaagcgaatataaagagaaacgatggaatgagtttttcctgtaccggcagatgcctcaattaaactgaccgcacttaacggagtagaaataggattaaaaggttgaaagacggatatgcgtaaggaagaatattgatcttgtaagctggtcatgaaattaagcatcttcgatagaacatagaatattgactaatttacctaacctaaactctttttgcaaaccttcaaaccgatgtaaaaataaaacggagcagatcttccgctccgttctcatgttatttgccattcaaactatctaaattacgtaatgcttcaatacgtttttccaatggaggatgacttaagaataaagaagcaagtcccccacgttttccattgatggcaaaagcagctagctgcccctccatttcttgtggctcatgcaacgttttcaaacgttgtaacgctgcaatcattttatgtttacccactaattccgctgaacctgcatcagctttaaattcacgatagcgagaaaaccacattgcaatcatacttgccaatacaccaaacacaagctcaagaaccattgaaatcataaaatatataccttgactggtatttccatcacgatctgtagcaacaacttttgccagcattcgagaaataaaaatgacgaacgtatttaatacgccttgcaacaaagtcatcgttaccatatcaccgcttttaatatggcttacttcgtgagctaaaaccgcttccgcctcatctcttgtcatagcatttagtaatcctgtactcacggcaacaagtgaattcttttttgtcgcacctgttgcaaaggcatttacatccgctgaatgatagatggcaactgtcggcataggtaatcctgctctttctgcctgtgaatgcaccgtttgaagcaaccaatgttccgtttcattacgaggttgctcaataacttgaccatttaccgaacgtaatgccattgattttgacatcagtaaagaaataatagatcccgtaaaaccaaataaagtagcaaaaatcaacaatcccaccgcatcttggcgttgaataccggtcaacgtcaaaataatgttaaaaacaaataaaacggcaaagttagttgctaaaaatagcaaaattctcatcataataaagttcctttacattaaaaattccccgcctatgataaggacaaaatattgaaactcaagggtaaaataaaaaaatttgttaccataaactcatttgtttttgctcaattattgtgggaatactgacatataatccaactaaacgcacagaacgattttgatgtcgttgccaaatttgagttaacagttttacaaaattttcttgcgaacatttcaccgcacttttttctaatgttgttatttggaagtcataaaattttaatttcacgcctattttacaaaaacattctaagggaatagcaggacaagtctttttaattcgtttcaataaaagaggataaaggctattgataacctcaataccttgttcaacttgcaaaatatttttcattaaagttcgttccagcccgatagatttaggttcacgatgagactgcacagggcgttcatctataccttgactaaattgccaaatacgatgtcctattttaccaaatcgatcgattaaaacatgatagtcaaattgttgaatatccgaacaagtttccaatcccatttgctgtaatcgttgcgttgtcacttttcccactcccggaatttttttcagtggaagttgcctaataaacgttgcaacttcttcaggtttaataacaaactgtccattgggcttattctgatctgaagcaattttagccaaaaattttaacggagcaataccggcagatgccgttaatcccgtttcctgagtaatgatttgtctaatttcttctgcaatccacgttgctgagcctgaacatttttgacaatccgttacatccaaataagcctcatctaaagataaaggttcaattaaatccgtataacgcaaaaaaatgtgttggatttgttgcgaaacctgcttatataaaggcatatttacagctaataataccaaatcgggacaaagtttcagtgcttgcgatgttggcattgcactatgtaagccaaactgacgagcaacataattacaagtacttaataccccacgctgattagccaatccgcccacagcaacaggtctatcatacaattccggtttatctcttatttcaatagatgcataaaagcaatccatatcaatatgaataattttacgaaacatcattgttaaaagtgcgattaaaatgttcaaatttgaccgtattctaacatttttactgtataaataaacagtttttgttgcttttcttatttaacatcatttatacctatttttctccaagtaatgtcttttagttatgcttttttgaaagctgtacattttatcctccttttttccgatacggtcctaccagctaaaatttttgacaaaatcactgatttttttgcaaaaaaggcatagaatacaggacgcatttgcaccttaatagaaatgttattaaaatgcggtgttattttgtgctaaaccatttttaggaaaatcagatgagccaagaatttttggattttgaactgcctatcgccgaattagaagcgaaaattgaggctttacgttcagtttcacaacaagatcaacagattaatttagatgatgaaattactcgtttacaaaagaaaagtgcagagctaacgcaaaaaacttttgctaatttagatgcttggcaggtatctcaaatggctcgccaccctaatcgtccttatactttagactatattgaacatatttttacagattttcaaacactggcaggcgatcgtgcttttgctgatgatcaagcaattgtcggtggattggctcgtctagaggaacgtcccgttatgattatcggtcatcaaaaaggacgtagcattaaagaaaaagtaaaacgtaactttggtatgcccgcacctgaaggttatcgcaaagcattacgtttaatgcaaatggcggaacgattcaagttgccaatcattactttcatcgacacgccgggggcttatccgggggtcggtgcagaagaaagaggtcaatctgaagctattgcacgtaatttacgtgaaatgtctatgttaaaagtaccgatcatttgtacagtaattggtgagggcggctcgggaggtgcgcttgctatcggtgttggtgataaaatcaatatgctgcaatacagtacttactccgttatttctccggaaggctgtgcctcgattttatggaaaagtgcagcaaaagcctctacagcagcagaagtaatgggcttaacagcttctcgtttgcacgaattaaaactgattgatagcataattgaagaacccttaggaggtgcacatcgcaactatgacactatgtcaaataatctgaaaaaacgtttgttagccgatcttgccgacttggataaattagatcaagagactttattagatcgccgttacaaacgattaatgagctatggttattgctaattttataaaaatagggcggtcttataccgctcttttctatttatagatatgttatagaggaagaaaaaatgaaaaatattctctcaattcaatctcacgttgtttatggctatgcaggcaataaatcagcaacatttccgatgcagttgctaggcattgatgtttgggcgttaaatacagtgcaattttctaaccatacacaatatggaaaatggaccggcatggtcattcccaaagaacaaattggtgaaattgtacaaggtattgataatattggagaacttcatcaatgtgatgctgtcctgtccggttatatcggctcagcagaacaagtagaagaaattataaaagcctttcataaagtaaaagaacgtaatccaaaagcaatttatttgtgcgatccggtgatgggacatcctgataaaggctgtgttgttgcagatggtgttaaagaaggactgattaaaattgcgatggctcaggcagatattattaccccaaatttagttgaactaagagaattaagcggattagcggttgaaaattttgaacaggctattgaagcagtaaaagtgattctaagtaaaggtccgaaaaaagtattggttaaacatttaagtcgtgttggtaagaatgctgcacaatttgaaatgttattggcaaataatgatggtatttggcatatcagtcgcccattacataatttcaataaagaacctgttggtgtaggtgatttaaccgccggattattccttgcaaacctactgaatggaaaatcggatgttgaagcatttgaacatactgcaaatacagtaaatgacgtaatggaaacaacacataatgcaggcgtctatgaacttcaaactattgccgctcgtgaatggattgttaatccgaaaagccaatataaagcagtaaaaataggttaatcttattaaattgtaggggttattactcctacttttaatatttccaagttcaatagatttcgatcggaatccctatggatttattacaacagttacaaaatcagttaaatcagtttccctctcatactaaacttctactaggatttagtggcggactggactcaacggttttgttatctttattggcaaaactcagaaaaaaacaaccgcacttatccttacgggcaatccatattcatcacggattaagtcaaaatgcagataactgggctattcattgccgacaaatttgtcagcaactggatatttcttttctgtgtgaaaaggtgacaattaatcctcgtaaaggaattgaggctgatgctcgtgaagcccgttatcaagcgattgctaatcatctacaagacaacgaaattcttgttaccgctcatcatcaacaagatcaaacagaaacctttttgttagctttaaaacgtggcagtggcttacagggattgggggcaatgcaaatacagagtgttgtttttaatctgcctatttttcgcccgcttttacattgcacaagacaacaacttgagcaatatgctaaaacagaaaaacttagctggattgaagatgaaagtaatgctgataatcgttatgaacgtaactttttacgtaacgatattttgcctaaacttcgtcagcgttggcaatctattgataatgcggtacaacgtagtgctcaacattgctttgaacagcagcaactgattaatgaattgcttaatgatgaatttaataaaatttacgataaattcgaccgcactttatccattgccaatttcgctacttactcaattttaaagcaaaaagccttactacgaacttggttacaacatctccatattttgatgccttcaacaatacagttggataatattatgagaaatatgattcaagcacaagaggatcgtaatccgacatgtagacttggaaatcaggtcttacgccgttatcaaaaacgtctttatgctacgccgatattacaagatttaagtcatattcgcctagatattcaagctaacgaatgcattaatttaccggataatttaggtgaaatttgtttactaaccaaaaatgagcatttgcaggttacatggcaaaataaacagattttattacccctgacacaggaaaaaatagaaattcgctttcgctattccggtaaagttaaactcccgcaaggatttcatcaagaaatgaaaaaatgttggcaagatcataatgttcccatatggcaacgcactcgtattcccttgattttttatggcaataaatttaaaagtgcggtaggtttttttaataattgtgagtaaaaaaataaccccatcttgatggggctattttaagaaccaatcctatcttaacgccaacttttaaactgattaattaaaccattagttgaactgtcgtgactattgatttgctcatctccaaccagttctggcaaaatgcggttagcaagttgtttacctaattcaactccccattgatcaaaactgtaaatattaaaaattaccccttgtacaaaaattttatgttcgtacatagcaattaatgcacctaacgtgaatggcgtaattttttgcactaaaatgctgtttgtcggtttattaccggtaaaaattttaaacggtacaatatttttcacttcatctaaggactttcctgcttgaataaattcagcttcaacttcttgttgtgttttaccaaaagcgagtgcttctgtttgtgcaaagaaatttgaaagcaatttattatgatgatctgacaacacattatgggtttgtgctggggcaataaaatcacaaggaataatcttcgtcccttgatgaattaattgatagaatgcgtgctgaccgttagtgccaggttctccccaaataataggaccagtttgataattattaatcacttgaccactgcgatctacatatttaccgttagattccatattaccctgttggaaataagctgcaaaacgatgtaaatattggtcataaggtaacatcgcttcagtttcagcacctaagaaattacagttccaaataccaattaacgctaacgtaatcggaatattttgttccattggtgcggtgcggaaatgtttatccatttcatgtgcaccagctaatagttgctcaaaattgtcaaacccaatagaaagtgcaatagaaagtccgattgcagaccataaagaataacgaccgcctacccaatcccaaaattcaaacatattgtgagtatctataccaaacttctccacttcttttacattggttgaaagtgcagcgaaatgcttagctacttggctttcatcttgtgcggctgctaaaaaccatttacgtgcagaaatcgcattagtcatagtttcctgtgttgtgaaagtttttgaagcaactaaaaataaggttgtttccggatttacttttttcaacgtctccgctatatgcgttccatcaacattggaaacaaagtgcatggttaaatgatttttatagggacgtaatgcttccgttaccatataagggcctaaatccgagccgccgataccgatattcaccacatcggtaatcgctttaccggtgtaacctttccaatcaccggaaataacacgttgacaaaaagatttcattttcgccaacactgcatttacttccggcataacatctttaccatctacataaaccggtgtatttgcacaattacgaagtgcggtatgtaatacagcacgattttctgtacgattgatcttttcaccattaaacattgcttcagttgcttcattcaaagcacattctttagctaactgacgtaataaagataatgtttgttgattaatattattttttgaataatccactaaaatttgttcggcaaattttaacgaatagtcattaaatcgagtcggttcttgctcaaaaagttgttgaatagtaacttgatttaagtctttttgatgttgctctaaagctttccacgcattagtttgagttggattaatattttgcatcatttttcctctctatggtttaaaaagttaatcaatatattcgatcaatactctaggtgttaatttagtgataagttcatagcttatcataccgctaattgcagaaatttcctcaataggtaattcctttccccataaaataacttcatcacccaccttatcttgactctcaataccaagatctaccgttaacatatccatcgatacacgcccaacaattggtacttttctgccattaatatagaccggtgtaccttgaggcatatcccgtggataaccatctccatacccaatagctacaacgcctattttggtatctctctcactaatccaacttccaccataccccacaggttcaccttttttatgatttctaatagtaattaatgaagaagttaacgtcataaccggaatcaatccataaacctcagcaggcgtattattcggcgagataccatacataataatacctggacgaatccaatctaaataggcttgctgccaaaacaaaatacctgatgaggcaacaatagatcgctcaccttgtttaccctcagtaacttgtaaaaaacgctctaactgaatttccgtataaccacacatcaattcatctgcccggctaaaatgactcaaaaacccgatttcttttacatttgaacattgaacaagttgctgataaaagtcttctacctgttcaagatctacacctaaacgatgcattcctgtgtcaattttcaaccatactttaattttattcggcaacttggctttcttaagctcataaagctgttcttgattatggataactgtttgaatattattaacagcaataattggcaaatcatcctcggaaaaaaaaccctctaacaataaaataggtttagtaataccttcagcacataaacgtaatgcttccgataatctagccacaccaaaacagtcaaccagatgatgcagagtagaggaaacgaactccaaaccatgtccataagcatttgccttaacaattgcaatgactttgctgtttttggctttttgcttaataacttgaatattatgttttaatgcaacagaactaatcctggctgttggaggtatgacattcattgattcgactctaatcttattttgtataatactgcggtatatttgctaaattatcaaaacgtgaatattgcccctgaaaggctaatttcactgttccaataggtccattacgttgcttaccgataataatttccgcaatgcccttattatcttccgttgtttcgttataaacttcatctcgataaataaacataatcaaatccgcatcttgttcaatggatcccgattcacgcaaatccgagtttataggtcgcctatcccctctgttctccaatgtacgatttaactgagaaagtgcaaccacaggaacttttaattctttcgctaatgcttttaaggaacgagaaatttctgcaatttctaaagtgcggttattttcaaatcctggagctcgcattaattgcaaatagtcaaccatgattaaacttaacccgccattttctcgatacactcgtcttgccctggagcgtaattccgttggtgttaatcccgaagaatcatcaatatacaagttaggtttttgcttaaacatcccaaaggttccggaaattttagcaaaatcttgctgtgttaaattacctgtacggattttaacctgatccactcgagaaagtgaggctaacatacgcatcaaaatctgttcagccggcatctccaagctaaaaaccaaaaccggtttttccgataacatcgcagcattctcacataaattcatagcaaatgttgtcttacccatcgaaggacgagctgcaacaataattaaatcggatttctgtaatccagatgttttttgatccaatgcagtaaaaccggttgaaacaccggtcacaccgttatttgttggtgtagccgccagattttcaattttatcaatagtgttaaaaagaagatttattacattttgcggtccttcattagctgatgttcgtttttccgcaatagaaaatatatcacgctccgcattatccaaaatgtcttttattgcttgcccatttggtttatacgcattttttacaatattatttcccactgaaattaactcacgtaaaattgctttttcacgcacaatttcagcataagtcaaaatattggcagcactcggcgtattgttggacaactctgctaaataagcaaaaccaccgacctcttcactttttccttttgtctttaacacctcatcaagaactaataaatcaacaggggtattctgtgcaaataataatgcaatttcttgaaaaataatccgatgttcaaaagtataaaaatcttcggcaatgatctgatccgctacgctatcccaataacgattatctaatagaatcccacctaaaacggcttgctccgcttcaatggaatgaggaggaatgagggtttgctcaaattttttatctttgatccgtgcagattgatttgaaccggtagttgctttagtcattaaaagaaaaattacctaattagaaattgaaaactgtgctatatgatataccaaatctaagcgagaattaagagagagggaaaaattaatcaaaacaatataagtgataaaaagcaaccgcaccttaaagtgcggttatttttgagaaattttacttcttacgtcgttcaattaatgcttcagacaattgttgtaatacgatttctgtatctgaccaaccaatacaagcatcggtaatactttgtccataggtaagtgcttttgcttcaactaaatcttgacgaccttcaactaaatggctttcaaccatgacaccaaaaatttgttttgaaccattagcaatttgagtacaaacatcagtgcaaacatctaactgttttttaaattgtttactactgttcgcatgactaaaatccaccataacatgcggaatgcgaccggttttttctatatccgcacaaactgtccgaacatcttccgcactataattaggacctttctcacctccacgcaaaataatatgacaatcctcatttccttttgtagacacaattgctgaatgaccgaattttgttacagatagaaaataatgtggtgcttctgccgtacctattgcatcaagagcaatgcgaactccaccgttagttccattcttaaagcccaccgcacatgacaaaccggatgccaattcacgatgaacttgcgattccgttgttcttgctccaatagccccccaactcataaagtccgcaaggtattgcggtgaaatcatatctaaaaattcaccggcagtaggcatttccatatcgttaatatcagataataatttacgtgcaatacgcaaaccatcatttaaagcataactaccatctaaatgaggatcattcactaatcctttccaacccacagttgtacgtggtttttcaaaatacacacgcattataatttccaacgtatcatgatattttatacgcatttctttaatgcgtttagcatactccaacgcagaagcaggatcatgaatagaacaaggtccaataataacgagtaaacgatcatctttttgatgaataatgttatgtgctgccaagcgggctttttttactgttttaatggctacatcacttgcaggaaatttttctaataatgcaatcgggggcaaaacttgctcaacttttgcaattctggtgtcatcatttgcaatacgaatattatttttattcttagccatatactactctctcttactacataaaatttacaatcatagaattaacaatttatatttaatggtattaaacgtaacatttatttttgtactagtaaactaatttctcctagtacgcacttaagacttgtgaaggttgtaatttagccgctcggcttgctggatataaacttgccaataaactcaacatcaaagcgaccactagtaccataagtacatcttgccaatgtaattcgctcggtaaaaaatcaataaaataaattccatctgataataactttttatccagtaaaaattcaataaattgaatcagaccggttaaatttaaactcagtattacccccaatgctattccaactaaacagcctttcatacctgattgcaacccgtaccaaacaaaaatttgtttaataaaacgattattagcccccaatgtacgcataatagcaatatcagcctgtttatcttttactgccataatcaaagttgacacaatattaaagcaggcaacacctatcaccaacaccatcgcaatatacattactgttctaattaactgaatatcgttatacatataaccaaacttgccaatccaatcttgaacttgtaggcgttgcggataatcatataaatattcatacgtcatatttctaaccgcaaaaggatcttgaacttttagctcaaccccagtaatttcatcgggcgtataatccaataatacttgtgcttgcgataagctcatcaacgcataactatgatccaattgcccatctaaacgcaaaatacctgttacttgaatgcgataacggagaggctgagataattgattatcgctattagcaaaagaaattaataacgttacccaatcattttcggatacacctaattctttcgcaatgccatagcctaaaaccaaaccgccatttttctgaaattgttgccagccatcatttaacacaaatttactcaaattactcacttgatcttgtgtaacttgttctattcccctcacttgagctactttcagttttgtgccgttttcaattaatgccgtaaattcaacaaaaggggattgtgctaaaacatttggatcctgctgtaaaagtgcggtaattttttgtcgactttcaatcttgacatttccttgctcttgatacgatataatttcactatgtggaacaacagataaaatacgctgattaagttctcgctcaaaaccgttcatcgcacttaatcctacaatcaacactgccacacctaatgcaattccaatagttgaaaataaagcaattaatgataccaacttatttttagaacgactgtattgataacgccagctaataaaaaatggagtattcatgagttactttccctcaagataccgtcttgcatcactaagcggcgacccaacttttccgctaattgcaaatcatgagttactaataaaaatgcaattttttgttcctgattaagtttttggataagttcaaaaatactttctgttgtcttatgatccaaatttcccgtaggttcatcagccaacacgagttttggattattcaccaacgatctagcaattgcaacacgttgacgctctccgccagaaagtgcggacggtttatgcaaaattctcttagccaatcccaccgcacttagtatattctcagctcgatctttcgcctctgttttatttttgtgactaattaacatcggcatcatcacattttcaagtgcggtaaaatccgccattaaatgatgaaattgatacacaaatcctaaatactgattacgcagtttagctaattcgtcctgtgttgccctttgtagtgattgcccatgaataaaaacttcaccgcttgttggctgatctaatccgcctaacatatgtaaaagagtacttttgccggatccggaacttcctacaatagcaattaattctccttcctgcatggaaaaagacacctcttttaagacttgagtttgaagacttccttcctgataatgctttgtaatattttgacagattaataatctattcatcgtttgctccagttctcttattattcataacgtaatgcttgtgccggctcaattttactcgctcggtaagccggataaattgttgatattaaagataatgttaacgagaaaaataaaattaacgcaatttgataaacgttaatttctgtcggtaaaaaaataccctgaggattaatccactgaataatcttcgctaaattcattgctacaacaacccctaaaccgccacctaacacagcaccgcttgcccctacaaaaaaaccttgcaaaataaaaatattacgcacttgtccttttctcaatcccagtgtttgtaaaatagcaatttcaccttgtttatccaccaccatcaaacttaatgaagtaacaatattagaaaccgccaccacaataattaaactaattagcaagctcatcatattcttttccatgcgaactgcttgaaaaaactcccctttttgactacgccaatctacaattttccattgctcagtagggaaaaacttaggcaattcactaatgaaaaaaggatcttgcaaaaataagcgataaccttgaacttgttcaggtttaatccgcattaagcgtccaatatccgctaaattggcaaaaactgcatagcttgcctgttcagaagaggaagagtaaatatcactaatggtaaataaacgttgtaccggaactcggccaaagggagtatattggctattttccgtcaccatcactcgaactttatcaccaatctgtacgtttaatttttgtgccaatttccaaccgataattaatttaaactcaccgattggaagaagttgcgaaaaatgattttctgaaaactcactcaataaaggatcatcagaaaatttttgcaccccaagaatttgcccggcactgacaccttgtgcagtttgaaacacgacagaagttgtattaatcggcacaactttttgcacaaaatcgggcatgtccggttgcgaggcggtcaaatatatagaattatttttaggcatcaaaatactgtgcggaatattggaaagaacctgttgtttttgatatttttccaagccgttcatcacagacaaaacaataattaacgccataacacctaaaataataccaacggtagcaagcgtcgtaactaattgcccgaagtgatccgcacttttagcccgccaatagcgtaatgcaataaaaagagaaattggaaaggtcatcttataatctataaaattacaaatctatgaattcacgttgcgactacatcaagaaaataaaaacaataaaattggatttattaaaccagtgttttctttgttactgaaaattaatctaacaaacccaatttagtcatttttactgagtaaataaaatcagcttaactaattatttacctgttttgacaaactcttcaatattttgtgcaactttgttcaccaaagtggtcaccgcactatctgatgcccatgcaatatgtggagtaacaatcaagtttggtaaacgagtagctgcctgaataagcggattctctttctcaggcggctctttaaccagtacatcaatagccgctgcggcaatcactttattttccaatgcttcaaccagtgcctgttcatcaactaaagggcctcgtccggtattaattaagtaagccgtcggtttcattaactttaacgtttctgcattaatcaaattttgtgtttgctccgttaaaggacaatgcaaagtcacaatatccgcttgctttaaaacctgttcaaaaggtaaatatcccgaacgaatttccgttgcaccacaacgttcagcgtaaatcacattcattccaagtgcggtcgctaatcgaccaatttctgaacctaaacaacctttacctatcacgcctaaagttgatcctttaacatcggtaatcggataatcaaaatagcaaaattgtttacagtctgcccattttgcacttaactgatctttgtaccaattcattaaactatgttttaaggcaaaaattaaacctaagacatgctcagatacggttaccgaagaatagccggttacattttttactgtaatacccaattctttagctgctattaaatcaacattattcgttcccgttgccgtaatagcgattaattttaacttaggtaattgcaacatcacctcacgactgaaaataaccttactggtaataacaatatcagcctcttttgcacgatctatcaactgatcagcatcggtatattcatattcaatccattgatgctcaaaacttgggcgaggaatagtaatatgttttggaattgccgtactgtctaaaaatacaatttgcatcattttctccttagttaattggaataggccgtgtcaatataccaaagtaataaacataaatatagaaaaaatccgtattcactaaaaatacggatttttcattatgctcatttaatttgacgtatctatttcctcaaaagatttaactagatcatcaatagctttcatttgtgcaacaaaaggttcaagttttgataaaggtaatgccgatggtccatcacactttgcttggtttggattaggatgagattctaagaataatccggctaatccaatcgccataccggaacgagccaattcggttacctgatcacgacgaccaccggaagctgccccaaaaggatcacgacattgtaaagaatgagttacgtcaaaaataacagggcaaccttgcgacacttttttcataatattgaaaccgagcatgtccactactaagttgtcataaccaaaattagtacctcgatcacacaaaatcaccttattatttccacattctgcgattttttccacaatattgcctatttgacctgggcttaaaaattgtggttttttcacattaatcaccgcacctgtacgagccatcgcttcaactaaatcagtttgacgagctaaaaaagccggtagttgaataatatcaacgacttccgctacaggtcggcattgataaatttcatgtacatcagtaatcacttttacaccaaaagtctcttttaattcttggaaaatttttaatccttcttccattcccggaccacgataagaatgaatagaagatcgattagctttgtcaaatgaggccttaaatatatagggtacgcctaatttttgcgtaacttctacatatttttcacaaacttgcatcgccatatcacgactttccaacacattcataccaccgaataaaacaaaaggcttattattgccgatttcaatattgcctaactgaataacttgattttgcataatcatttccttactaatgaatagattcaatttctaattgtaaatattccaattgaggtaataataaaagtgcggtcggatcttccggacatttttctaaaaaatattcaaagtcattcaatgccgcttgcatacaccccatttgagttaataccaccccacgatcacgaatttcataaggatcatcaggatttctggacaagagcatatcaatatattgatatgcctcattatttctaaattcacgaattaacgcatgctttgctaattgacaaaaccgattcgttaattcttgcacatctgcaacttctaatatctccaagcttaattcagtaccaaaaccaaatgctccttcatataacttttttagctgagaatatgtcatatattgaccattccaaggatcaataaaggcgacctcttcatcaacatcagcacgcaaaattaattgcgtaggaaaattgaccggataaatgggcaaattcaaactttcagccaagtataaaactattgctcccagtgttaccggcattcctcttcgttgcgttaacacttgatccaaatataaattctccaacgcaaaataccgttcgggatcacaaaaaaatccccattctccatacatcaactgcaataaatgatgaatttttcttttagtttcccaattagaatcaatttttttacgagcttcacgaaccaaaccgccaatcatgcctcgaatacgccgtatttctttactactattgtcatgcgtaataagataaaaagaggtcatttcatcatataatgctttatgataatacttcattttttcctcttaattgagctaatgttattcgctcattaccgccataatcgttaatcgtttcaacttgtttccacagtttctcggcaaaaaaagaccgcactttttgcccttgctgccagccatgctctactaataaaaaaccttgtttttttaaataattaggagcttgctcaataatatattgcaaatcggcatatccttttttttctgccaccaacgccgtcaaaggctcaaaacgtacatcaccctgatttaaatgctgatcttccgcatcaatataagggggattactgacaattaaatcaaattgtccagttacttgctcaaaccaattactttgcaaaaactgtacttcggtcaaatgattacgcactgcattagtttttgctaatttaacagcatcggcaataacatccagaccaaatatctcaaaatgttgaccgctctttttcagttcatcagccaacgccaaagctatagcacctgtccctgttcctaaatctaaaatacgaatgggggattgagtaaagtcttttgatttcttaagcaattgaatgcaaaccagtgcttgttcaaccaaaatctcagtatctggacgtggaattaaagtatagggagccacctgtaaatttaatgtccaaaattccgtttcacccagcacatacgccattggttcacctttagcacggcgaaccaataattctgtgagttgtttcaattcatcctctgtcaataaggtttctgaaaaagctaaaatcgctgattttgaacgtttagtgacggtttgcaataacaaatttgcatcaactttagcatctaagaaaggatctttagcaacattctcaaataaacgtttttcggcaagttccagccattgttgataattcatttctttagtgaaacttaagttttcttcacaacgatagtcgacataactatatccactaacgaacgtctttccttatttgcaaaagcaacaattgcactaactaaagttaagatacctgttaatgcaaaaagctgttcaataaattcacgcaatacataacgaccaaatgttaagggttgatttgttctatagtctatcacttgtaaatttagccatttctttgctaatgtttgcttagcgttatacatgaggaataattgatatccgatatagaggaaaataaaaatgagacctgcaatctggttcaaaacaatagatccaaacaaaatagccacatagaacaacaatacatttatgagggaagccaaccaacgcttaaatcgactggcataaacgatatccgatacgttattagaatttgcttgtaatttatgatcttcttcaacaataaatttacgctgttcatcattagaattgtttttttcattgaatttttcaacaatcattgtatctccttctcataatcttaagaggaattttttcttcgtcaaaatagattaattttgttcggacaacattgccaactgatctgcttgatattccgtaataattggttgaattagctcgtcaatcttgccattcatcacttcatcaaggcgatataccgttaaattgatacgatgatccgttacacgaccttgcgggtaattgtaagtacgaattttatctgatcgatcgcctgaacctaataaattacgacgagtatccgcttgggcttgagcttgacgttcctgttcagcttgtgcaatacgagaagctaaaacggaaagtgccttcgccttatttttatgttgtgaacgctcatcttgacattccactacaatacccgtcggaatatgcgtaatacgcaccgcagaatccgttgtattaacatgctgaccaccagctcccgaagagcggtaggtatcaatacgcaaatccgacggattaatctccggcatttcattttccggtaattcaggcataacagctacggtacacgcagacgtatgaattctgccctgagattctgtttttggtacacgttgcacacgatgcccaccggactcaaacttcagttgaccatacacgccttcgccattcactttgacaataatttctttatatccgccttgctcactttcatttgcattcaatacttccacacgccaacgtttactttctgcataacgactgtacatgcgaaataaatcaccggcaaaaataccagcttcatcaccgccagttccagcacgaatttctaaataagcattgtattcatcatttggatctttaggtaataacaggatttgtaattgttgctccgcattttcaatttcagcttttgactcttctatttccaattcagccatttctttcatatcaggatcatcaagcaatagttgtgtttcttcaatattgttattcaaccaattccaacgtgcaaaacattttacaacatcttctaattgagcatattcttttgaataagcacggaatttatcttgatcgttaatgacagaagactccccaagcaacgcttcaagttcttcatgtctctcttttaagctctctaatttactaataatactggctttcattctctgaccttacaaaataataatgtaaatttaaatttcaaaacttaatatcaccgaaccattggtatattttatcgtgtattcgagtaccataaaaatcaacaatatttctatcatatttgaaaacagcggtggaaaataaggtaatcactctttcaaaattcacatcaagcaattcaaatagttcactcggcacaacatcttgatatacaaatacattctcaaaatacttttgataatctgttgtttctctagggtgtggttttatcactagcaaacgctcgtcataattttttatgatatgttgataaatggctattttctcttgttctgatattacacgatcttctgataaacactgcgtaaataatatatatttcttcatttttaacgatataagtgaatctaaattaaaagcaaagaaatccaatatgttatgttgttcttgagctgttcttgttttccataaatgctctaatgaaatcagttcaactttatgcctaatgtcacttggtacattttctaaagaggtcaaataaattttctttaccgtcttatgaaaaccaaaaacaggaatattccttgttaaattaatttcatatcttttaggactaaaattcgctatgccatcctcgattaaataaaaatcaaaatatttaagaaaataatctgtccaatctaaatgatcagcaccataaacaggaatacggtcaatcttaaatcgataaaaataaagtttataatagagacgccaaaattttgttattttctttttaatggcaacatagtgcttgattttatactttttatgtaattcaaaatcttcattaaaaacaaataacacttcatctaaatgatatttatttaacatcagaaaaatcaacaacattcttaaactactgacaataacaattgctttgatttttatattatacttcatgatattcaactattttggctctaaatcttagattattacccaactccgaaaacagaaaattcaattcgaggctgccttagaattacctaaaacagcctctatataataaccataatagcagagctacattacagaaacatttaaagtggagccaccaacaatacgaactcgagctcccggcactaaagttgcatcatacttttgcacaacaacaatttcttgtccattgtcttttctgataacaagttccaacgcattaatctgacttgctttttcttctactttactaccaattaccgctccggcaatagcaccaactgctgcagcgactgcctgtccggtaccaccgcctatactagatcccactattccacctaaagcaccaccaccaacagtcccaatcacaccttggttatcgccttgaattttaaccggacggattgattcgatgataccataactgattgaacgagctgatttagcttgtgtgccactatatacattaccactgtatatatcttcattggcacacccagctaatcccaaactaagtaaaatagctaatgataaagtcatttttttcataatagttaacctctcttttttgattaatttttagatgttctagaaagccaagaacttgatcttttacgagaaatatttgttactgttataccatcgtcattgtgagacacctctacacaagagcctacaactaaatgagaatcgtaagaatgacttaatacgatctccttaattcctccctcttgctgtttgcaatcatttttacgaatagttaattttaaattatttcctttttgagcagcgaacaaaatttcgcccttatacacattatcattttttgtagatgagcaagctgctaatcctaaaaaacctaataataaagtgaatgctaatgttacttttttcatcgaatctaaccctcaattatctttttgatatgatacgggtgaacttttatgcaagtatgattttctagttgattaacaaaactcactgcaatagacgggttaggtaattgctcgccatccgccttaggttcacttactttaactttcaaattagccaattcgtcccataaaaattgttgtcttatacgtgtaacccattcatcaacagtttcattcacttcaaatggaattacaacttcaatatgctcccagttttccactggatacactttatctttagggaacggtaattcaataatatcaataaactgatccgaaaaacgtatcggattatcaagttgaattaaataaataactctcccgtttacaatattaccgctcagaattgtaccgcactttaacagcaaagtcagccaatcctccgcagatttacgtttatttactctcaaggcaatatgatcaatttcaacacgatctaaccgtaattgcatgaaatgggctaattcaataatttttctttcaaattgttcaaactcatctaatgagatattagattgccgaaacaaagaatgattttggttaaaaatctgcattttttattgctttatcttttctgaataaggaaagagcggtatcataacgcattattttcacaaatcaattattaggtatatcagtgaatattcagtctattttatctaacaaaatcaaacaagcgatgcgtcaagccggtgcagatgaacaatgtgatgctttagtgaaaccatccggtaaacctcagtttggcgattatcaagctaatggaattatggcaacagctaaaaaactgggtttaaatccccgtgattttgctcaaaaagtactcgatctcattgatttaaaaaatattgccgaaaaaatggaaattgcaggccccggatttattaatatcttcttagataaaaattggttggcagaaaatattcaagttaccctacaggataagaaattaggcgttacagtcgaagaaattcaaaccatcgttgtagattattcctcaccaaatgtagcaaaagaaatgcacgttggacatttgcgttcaaccattattggcgatgctgtagttcgtacattggaatttttagggcataacgttattcgagcgaaccatgttggtgactggggtacacaattcggtatgcttattgcctatttggaaaaaatggaaaatgaacatgcttcagcaatggaactggcagatttggaagccttctatcgtgctgctaaagaacattatgataatgatgaaacctttgcagaaaaagcacgtaattacgtggtaaagctacaaaatggtgatgcttattgtcgcacaatgtggaagaaacttgttgatattactatgcaacaaaatcaacgtaattatgatcgcttgaatgtgaccttaaccccaaatgatgtaatgggggaaagtctgtataatccaatgctacctgaaatagttgcagatctaaaagcacaaggtttagccgttgaagatgaaggtgcacaagttgtttacctcgaagaatttaaaaataaagatggtgatccgatgggggttatcgtgcagaaaaaagatggcggtttcctctacacaacaacagatattgcagcggctaaatatcgttatcatacattaaaagcagatcgtgctttggtgttttccgacacacgtcaaagccaacatatgcaacaagcatggttgattactagaaaagccggttatgtgccggacagtttccagctggaacataaaaatttcggtatgatgttaggtaaagacggaaaaccgtttaaaactcgctccggtggaacggttaaactgacagatttattagatgaagcgattgaacgtgcggataaattaatttcaggaaaaagtaccgctctttcaagcaaagaaaaagcggctgtgatagaggctgtgggtatcggttcagtcaaatatgcggatctttctaaaaatcggacaaccgactatgtatttgattgggatatcatgttaagttttgaaggaaataccgcaccttatatgcaatatgcttatactcgtattcgttctattttcaacaaaaccgatattagcgaagaacaacttcaccctgcaaagatccagctcacagatgaaaaagagcgtttacttgcaattaaattgctacaatttgaagaaacagtacaaattgtaggcaaagaaggaacaccgcatattctatgtgcctacttgtatgagttagccggtttattctctagtttctacgagcattgccctatcttgaataatgataatgaaaacgtgaaattaagccgtttaaaactcgccttactcaccgaaaaaaccttaaaacaaggtttggatttactcggtataaaaacagtggaaaaaatgtagttcagatatttccattattggttcgtataaaaaaggcaacatccgttgccttttctgtaggttattaatttgctcatggtgtcaacaaagttcttaaaactttaccaatatcagccaaacttcttaccgttttcacgccggctttttccaaagcgacaattttttcctctgccgttccttttccgccactaataattgctcctgcatgtcccattcgtttgcctttcggagcggttactccggcaatataagccacaacaggtttagttacatgtttatggataaaatcggctgcttcttcctccgcacttccaccaatttcaccaatcatcactatcgcatcagtttcaggatctgcttggaataatttcaaaatatcaataaaactggaaccggggataggatctcctccaatccctacacaagtggattgtccaaacccttcatccgttgtttgttttactgcctcataagttaacgtgccggaacgagaaacaattccgatacgcccttttttatgaatatttcctggcataatccccattttgcattcctctggtgtaataacaccgggacaatttggaccaatcatcacgacatcactttgctgtaatttttttttcacctccaacatatccaacgttggaataccttctgtgatgcaaacaataaacttaatgcccccatcaattgcttctaaaatagcatctttacaaaaaggtgccggaacataaatcattgttgcggtagcaccagttttctccactgcctcacgaacagtattaaaaacaggcaatcctaaatgcaacgaaccactttttcccggggaaacccctccaactaattgagtgccataagctaaggcttgttcacaatgaaacgtgccttgtttaccagtaaaaccttgacaaatcactttggtatttttgttaattaaaattgccattattcactctcctttgctgcattaactgcttgttccgctgcttcagttaagctgtttacagcaattaaattcaagttactttgtgctaaaatttcacgtcctaagtccgcatttgttccttccaaacgcacaataactggaacactcacaccaatttcattgattgcggaaacaattcctttagcgattaaatcacaacgcacaataccgccaaaaatattcactaatacggctttaaccgcactgtccgttaaaataattttgaatgcttccataacccgttcttttgttgctccaccaccgacatcaaggaaatttgctggtcgtccgccatgtaatttaataatatccatcgttcccatggctaaaccggcaccattgaccatacaaccaatattcccatctaacgcaacgtaatttaaattccacttttcagcctcagcctcacgaggatcttcttgcgttaaatcacgcatagaaaacaagtcggggtgacgatacaacgcattatcatcaaccacaacttttgcatctaagcaaaataattcatcgttttttaaaataaccaatgggttgatttccagtagggataaatctttttcaacaaataatttggcaagttggcaaaaaatttggctgaattgctgaatttgtttccctgataatcctaatttaaatgccaattctcgcccttgatatggcatcgctccaaccaaaggatcgatagttaccctatgcaataagtgcggtgttttttctgctacttcttctatatccataccgccttcacttgatgccataaagacaatacgttgagagctacggtcaataattgcactcaagtacaattctttttgaatttccgcacagggttcaagataaatttgatgaatcggctgtccctgttcatttgtttgaacggtaactaaacgctgtcctaaaaacttagtaaaaaacgaccgcacttcttgtgctgatttaaccacttttactccaccagctttaccacgtccaccggcatggatttgacattttgcaatccattgagaacctgataatttctcaatcgcacttaacgcctgttcaacattttcacaaacataacctttagttacaggtaaaccataatctgcaaaaagttttttactctgatactcatgtaaattcatatcgtccccttattgatacgtttcaataccgcacttttagattatcggtacttctaaatttccagtagcaagcgagtcggatcttccagcaagtccttcactgtcaccaagaaaccgacgctttcacgtccatcgattaaacggtgatcatagcttagtgccaaatacatcattgggcgaataaccacttcaccattaaccgcaacgggacgatctttaatcgcatgcatacccaaaatcgcactttgtggcggatttataataggtgttgacattaaagaaccaaaaacgccaccgttagtaatagtaaaattcccccccgttaaatcttcaacggtcaattttccatcacgacctttttccgccaacaatttaatttctttttcaatatctgccatacttaatttatcgcaattacgtacaaccggcgttaccaaacctcgaggtgtggaaacagcaatactaatatcaaaataattgtggtaaacaatatcatcaccatcaatagatgcgttaatctctggatagcgttttagtgcttcaaccaccgctttgatataaaaagacataaatcctaagcgtgcaccatgttgtttctcaaatttttctgcataacgcttgcgtaaattcataatcggctgcatatccacttcattaaatgtcgtcagcattgcagtagtattttttgcttccagtaaacgctctgcgatacgcttacgtaaacgtgtcattggtacacgtttttcattgcgatgatcaattttcaacccagttgcaatagactgagatgcttgtgccgtttctgtttgttgtactttttgcttaaccactaacgctatatcttcacgagtaattcgaccacctacacctgtacctttaatttcatcagcatttaattcatgctccgctaacaaacgacgaacagccggactcagtacatcgctacttgcatcagtattcaaattagccgaatgacgatctgccggtgttttttccacattctgtacagttgattttgtaacttctccaatacctgccgaagcggatactttacccaacaattgtttactcacgacagttgaaccttccggttgtaaaatagtttcaagcactccatcactaagtgcgggaatttccaacacaattttatcagtttcaatttccactaaaacttcatcacattttaccgcatcacccacgttcttatgccacgttacaacggttgcatccgccacagattcagggagatccggagtaataatatcgaaattgctcatattttttcctcctattcatatttcgcttaaaattagatatatatccgttaattattgaaaatttttccaatactttaacctggcaaaattacgctaatgcctcagttaccaaagctcgttgttgctcattatgtaaagataaatagcccactgccggtgaagctgaagctggacgaccaacataacgcaacttaccatgtggcggtaacgacgtccaaaaattatgctgacaacaataccaggccccttgatttaaaggttcttcttgacaccaaacataatcagtcacatgagaataaggttctaaagcctctttcatttcttcatgtggatatggataaagttgctcaatacgaataatagcaacatccatttgattattttctcggcgttgttccaataaatcataataaacttttccggaacacatcacgacacgacgaactttttgaggatcaatcgcatcaatttccgcaatcacattttgatattttccatgtattaattcttccatagtagatactacaagcggacggcgtaacaatgattttggagtaataacaactaatggccgacgcactttacgcagcatttgacgacgtaataaatgataaatttgtgccggagtagaaggtacacatacttgcatgttttgctgtgcacagagttgcaaataacgctccaagcgagcagaagaatgttctggaccttgcccttcatatccatgtggcaacaacatcactaaaccacacatacgcccccatttttgctcgccggaactaataaattgatcgatcacaacttgtgcaacattcgcaaaatcaccaaattgtgcctcccaaatagttaatgtccgtggtgccgctgttgcgtaaccatattcataagctaaaacagcttcttctgataatacagaatcccaaacttcaaaacgcccttgttgagcatgtaattgagttaatggaatatacaacgtcgcatctttttgattgtgtaatactgaatggcgatgaaagaaagtaccacgtcccgcatcctcaccagataaacgaacattatatccctcatcaagcaaggtcgcataagccattgtttcagccataccccaatcaaataatttatcgccttgtgccattgataaacgatcatcgtaaagttttttcactcgaggatgtaatgaatgcgaacttggataatcacatactttcttagctaatccgacaaaacgctcagcatcaaaggaaccatcatactcagtccattcttgcgttaaatacttagtccaatctttcgtttcaatatccgcttcacgccattccggtacaacacaacctccattatccaaggcatctcgatatttatttgctaattcaattgcatatgcttcatcaatgataccttcagtaactaggcggttcgtataaactttcgggggtgttggatgcttacggatacgttcatacataagcggttgagtaacagcaggttcatctgcttcattatgcccatgtcgacgatatgacaccaaatcaataaaaatatcacgcttaaattttgctctaaattcaaccgccattcgtgcagcataagcaacagcttctggatcatcaccatttacatggataaccggtgcctcaatcatcttcgctatatcagtacaatattctgttgaacgtgtatcctgtagatttgaagtggtaaaaccaatttgattattaatcaccacacgaattgtcccaccaactgtatagcctctcacttctgacatattcagtgtctcttgaacaatgccctgccctgcaaccgcactatctccatgcaccgtaattggtaacacttgagaacgttcaacgtcctgaatacgattttgtcttgctcgcacagaacctaagacgacaggatttacaatttctaagtgggaaggattaaatgccaacgctaaatgtacaatgccatcgtcagtcataaaatcagatgaaaatccttgatggtatttaacatcccccgtcccactgccactatgcttaccggcaaactcatcgaataattctgaaggctttttacccaacacattaaccaatagattcaagcgacctctatgtgccatgcccatcacaatttctttcacaccatttctgctactatgacgaatcatttctttcattaacagtataaaagcatcgctaccttctaaagaaaagcgtttcgctccagggaatttcgcccctaaataacgttctaatccatctgctgcaattaattcttctaaaaatttcagttgttcttctcgggtgaacagcggtttatctaataacctctcaactttgcgttgcaaccacgtacgagcgtcaagatcgttaacgtgcataaattctaaaccaatcgtactgcaataagtctttttcaacgaatcggctaaatcacgtaacgaaatttgctccttgttataaacataaccgccaatatcaaaaacttcatctaaatcattatcagaaaaaccataaaacttataatcaagcgttggtgcctccatacgttgccacatttttaacggatccaaatccgcatgtagatgccctcggttacgatgcccatttatccatttaagcacattaaccaatctcgcactaacattaggatctatcacccccactccattttgagaagtatcacgtgctaaacgtttaaaataatcacggacttttgaatgaggctgctcaagtgcgttctgttttggaagagaattgaaaacttgttgccaactttcgtcaacagcttgagggttatcaagataatcttcataaagatcctcgacataagactggttcgcaccacctaaagcactggatgccaaccattcactgatagggctattttttttcattatgaccacctaacttgattattgatagcaatttacagtgtaattttttccattatacatagatttagccataaacaatctatttatttgataagctatatcaatttcagctggaaattaaaaatcaaattacctatctaagcaataaaaaagttaaaaagttgttaataattttttatttttttgatctacatctcatttttaaacatccaacaccttatttgtaaaaataatgtaaaatttatgcagacagtaacaaaattaaacgttatattgaaaacatacacaaatattcaacatcttactttctttataaacttttaaactctcaagggggaatgtcttatgtctaaattaacagcaaaacttacacttagtgacggacgtgaatttgatttaaatgttcaacaaggaacgcttggatacgatgctgttgacgttcaaccgttagttaaaaataaattatttacttttgaccccggatttatgtcaactgcatcttgcgtttccgaaatcacctatatagatggtgataacggcatactgttacatcgtggttatcctattgcggatcttgctaaaaatgcggattatttagaagttgctcatctactgttatttggagaacgcccgaataaagaagaatatgccaactttataaagttggtcaaaaatcatactttagtacatgagcaaatttctcgcttcttccatggattccgtagagactctcaccctatggcgattatgtgcggggtaagcggtgccttagcagctttctatcatgattccttggatattaatgatattgaacaccgagaattaacagcaattcgtttattagcgaaaatgccaacgcttgcggcgatgtgttataaatattctattggacaaccttttatgttcccattaaacaaactttcttatgcaggaaattttttatatatgatgttcgcaacgccttgtgaaccttatgaagttaaccctgtattagaaaaagcgatggatagaattttcattttgcatgcagatcatgaacaaaatgcctcaacatctacagtgcgtaccgctgcttcgtccggagcaaacccttttgcttgtatcgctgcaggaattgcctctctttggggaccggctcatgggggagcaaatgaagcttgtattaacatgctagaagaaatcggttctgttgatcgtattcctgaatacattgcacgagcaaaagataaaaacgatcctttcagattaatgggattcggacatcgagtttataaaaattacgatcctcgagctaaagtgatgcgtcaaacttgccatgaagtattaaaagaattaaacattcagacaccgctctttgacgttgctatggaattagaacgtattgcgttaaatgatccttactttatcgatcataaactgtatccaaatgtcgatttttattcaggaattatcttgaaagcaataggtattccgacatcaatgtttactgttattttcgctttagctagaacagtaggttggattgctcattggaaagaaatgtttaaacctggcaatatgaagattgtacgccctcgtcaattatacaaaggacatacagaacgtaactttgatgccattgaaaaataatttctgtcagagttaaagtgaagctcgtctctttttgaatggcgagcttgattttttgtaccttattctatttttatcaaaatttacaataaatcgtggtaaaattagactaattaatcataatcgggaatttttctatggcatacactaccttttcacaaactaaaaataatcaattattggaacctatgttttttggtcaaaacgtcaatgttgcccgttatgaccaacaaaaatatgaaacctttgagaaattaattgaaaagcaactctctttcttctggcgaccggaagaagtcgatgtatcacaagaccgcattgattatcaagcactacctgaacatgagaaacacatctttattagtaatctaaaatatcagacattattagattctatccaaggtcgtagccccaatgttgccttactgccattagtttccattccggaattggaaacatggatcgaaacttggacattctcagaaacgattcattcccgttcttatacacatattattcgtaatatcgtaaatgatccgtcaatcgtttttgacgatattgtcacaaacgaagaaattatcaaacgtgcaagagatatttcttcttactatgatgatctaatccgtgacagtcaactttacggattatatggcgagggtacttatacagtggatggtaaagcctgtaaagtcactttacgcaacttaaaacgccaactttatctctgtttaatgagtgtaaatgcgttagaagcaatccgcttttatgtttcctttgcttgctctttcgcttttgctgaacgcaaattaatggaaggtaatgcaaaaattattaaatttattgcccgtgatgaagcactgcatttgacaggcactcagcatatcctcaacatcatggcggcgggacaagatgatcctgaaatggctgaaatcgctgaagaatgtaaacaagaggcttatgagttattcgttgcagcggcggaacaagaaaaggaatgggctgattatctctttaaagatggctcaatgatcggattaaataaagatattcttgtgcaatatgtggaatatatcacaaacattcgtatgcaagctgtgggcttgccattgcccttccaagcacgttcaaacccaattccttggataaacgcttggttagtatcggataatgttcaagttgctccacaagaagttgaagtcagttcttatcttgtcggacaaattgatgccaaagtagatacaaatgacttcggcgatttcgatctataaaacacctataaaatcaaccgcactttgacctaggttaaaagtgcggttgatttttactaaaaatgatgaagatttatcaagtttatatcagcaattaccggcaaacgcttacccatgccaacgaaatgcctttattggaaaaattagaaaaaaacggcattatacatgaatatcaatgtcgctcaggttattgtggttcatgtcgggtaaaactacaaaaaggcaaagtgtcttataaagaacagccccttgcctttcttaatcaaaatgaaatattactttgttgttgccaattggaagatgatatagaaatcgaactctaatctatacacacgcaaaaatgcgacttccaactcacttatctcttaaaaaatatttactggttagcgttttccttcgttgttacaaacaatagccaatatcctactacagccgatacactagaaccaaacaagatacctaatcgtgcataagcggttaagtgtccatctcccccaccaaaagcaagactggctaaaaacatcgacatagtaaaccctataccacaaagtaccgaaactgcaaatatctgtttaaaattaataccttcaggtagttttgctatatgcagtttcactgataagtagctaaataaaaacacaccaatcggcttacctaacaataaccccaacgtaacacccagtgttaatggtgaagttaatgcttccatacccaaaccagacaaaggaataccagcattacaaaaagcaaagagcggtaaaattaaaaatgagctccaaggtgcaatagcatgttccatttcaactaaaggttcgctgttatttttacctttcagaggtacacaaaaacctataatgacaccggctaatgtcgcatgcacacctgatttcaatacagatacccaaaggataatcccaacgacaacataagcgattaaatttgatactttgaaacgatttaacaaaattaagccaacaatagcaatacttgctaaaatcaacgcttttgtacttaaatcatgtgagaaaaataaagcaatcacaataattgcacctaaatcatcaataatagccaatgctaataaaaatacttttaaagcaagaggtactcgagtacctagcaacactaatacaccaatagcaaaagcaatatcggtcgccattggaatggcccaaccgccgtgataatcaggaacaccttgatttacgagccaatacactaaagctggtacaatcattccgccacaagccgcaattgccggaaaaatagccttttgatagctggaaatcgcaccaatcaacatctcacgtttcacttccaagccgacaagaacaaagaaaatcgccataaatccgtcatttacccacattaataacggtttattaagttcaacgatagatccgaattgaataatcaccggagcattcagaaaactaaagtaatgatctcttaacggagaattggcaaatatcaccgcccctacagaaaaaaccaataacaggattcctccggcggcctccatttgtaaaaattgacgaatacattcccgaattttttcagtcattattttcattattacttcctttgcataactaaaaacgcatataacaagtttttatcacgaacttttattgagggtcaaggcaaatcaaacaattttttctattggtaaaaaaaacacaacaaagttcacaataatattcaacaaatttaacaaaactttatacaaaaacaaatttactcaacacatttaaagctgttgatacactctcaacgcatacgcatcggacattcccgcaatataatcgcaaataattcgcttacgatctgtttctgttgctttttgccaacgcattgctgtattacgaggcagtaaacgcaacggatcactgtcaaaaatttgaaacatttcagtaagcattctttgccctttatattcgacacgttgtgtatcaacatgtttaatcacatactcccatacgaagtgtttaaaaatagttaaaacttcaataacttcatcaggtaattcggcgttataacgtaataaaggctcggaaaaaccattatttattttccaacgtacatgggtaataaaataattcaccaatgcaccgatggcatttttacgctcatagtgtaattccgaaaaaagtttttgactgagcgaggatatagtctgaacaatccattcagaacgacattctgttaatttttctactgcactttgccattgctgaaacgttaccacgccaacaacaatcgcatcttctaaatcatgtaccgcataagcaatatcatctgcaagctccataatactgcaatccaaagatttataacgggttttcaaaacctcatcaggacgagtacgctcttttttatattgcccgaataaagtgcggtcattttccgataagggtccaagtaaccattcaaacattttcaaatcatcacgaaaaatcccttttcccggtttccacgctgaaatcttcacatatttagaatcaacattatcgacaattaccccttgatgatattgtggggaagaacgatctaaaatcgtaggatatttaacaatgcccaataacgttcgacgagttaaattcattcctgcattaggcgtataaggctcaagcttagttaataaacgaaacgtttgtgcatttccctcaaatcccccatgatgacgcatcatataattcaaggcgacttctccgccatgtccaaagggcggatgaccgatatcatgagcaaaacaaaggctttcaatgaggtcattagacggcagtattaatttaagttgtttttgcaaatctgctcgatcttccttgagctgttgagctaaataaataaaactatcaataagtttcatttgtgccacaatactgctaccaatttgagcgacctcaagcgaatgggttaaacgagtgcggtaaaaatcattttcgcctatagcgtgaatttgtgtttttgcttgtaaacaacggaaagccgcactatgcaatattctcccacgatcacgacgaaaaggcggacgatgatctttctctctcggcggatcggcaagaaagcgttcttgccaagatgaattaatttgcaatttcatatttacctctcaaaaacaagcaaagtccacgtaattcatctcattatacaactcaacgtcaacaaaaataataaaatttatagcttgatttacttcttttattcgttttgttacgttttttcggtaaaatagacgaaattatcttgaacaacatcatcaatatgtggaaaaaaatcttttttattttatttttttgtgccatttctagtgtttcagccaaaaatccccgcattcttccttgttatgtagtgaaaattagtgatggcgatacatttacctgctcacttcgcaataacaaaaaagtaaaagtgcgtttacaagaaattgacgcaccggaaaaaggacagccgtttggtaaaaaagcccaacactatcttacaaagttaatttataaaaaaaacgtaaaattgcatgtgtcaagctatgaccgttatcaacgaatgctcgcaacggtttataactcacaaggaaaaaatattaatttagcgatggtaaatgcaggttttgcttgggcatatcaacaatatttaaaagatccgcagtatctacaagcacaaaaatacgcacaacgtaaacgtcttggcttatggcaagatcctcatcctgtgtatccacatcaatggcgtaaacaaaaaaagcaaaagataaaaaaatatgatttttgatccaacattatttcgccagcaatttcctttttttcaccaaaaaaatggtatcacttatctagacagtgcggcgaccaccttaaaaccgcaagttctccttgacgcaacgcagcatttttatgcttctgccggctccgtacatcgaagccaatatgatgcaaaacagaccgcactttttgaacaagcgagaaagcaggtgcaaaaactgatcaacgctgaaagtgaagaaaccgttatttggacatccggcaccacacaaagcatcaacattgtcgcctacggcttaatggcacaactttccccaaacgatgaaattatcattagcgaagcggaacatcatgcaaattttgttacttggcaacaaattgctaaaaagtgcggtgcaacattaattattttaccgttgcaagataatttactcattgatcaacaaattctacaaaaatccttaaacaaaaaaacgaaattagtcgccttaaatgtgatctccaatgtaacaggaacacaacaaccgctgacacagcttatccccatcatacgagaaaaaagcagagccttgattttattagattgtgcacaagccattaaccatcaaaccattgatcttcaaaggcttgatgcagattttatcgttttttccgcacataaaatttacggaccgacagggttgggtgtattaagtggaaaacgttctgctttagaacgattacaacccagttttttcggcggaaaaatggttgaacaggtttcaaaacaagaaactgtttttgcctctttaccttatcgcctcgaaagcggcacgcctaatattgctggcgtaatcggttttggtgcggtattaaattggctggaacaatggaatatcacacaaggggaacaatttgccgtgcaactggcggaaaaaacaaaagagcggttaaaaaattatcctcattgtcgcctatttaattcgccacacccaagcacatttgtttgctttacattcaccacaatcgccacatcggatattgcgaccctacttgcagaacaacatattgccttgcgtagtggcgaacattgtgcaaaaccctatttacagcgtctaggacaaaaaagcaccttacgcctctctttcgccccttacaataaccaagaagatattgaactgttttttagtgcattggataaaagtttggagttattggcatgattgaacaaatcaaacaagcgaaaaattgggaagaacgttatcgcttaatcattttggcaggaaaaaatctccgccaaccgacagaacagcaattggctgaaatggaaatcattcaaggttgcgaagtcaaagtatggtttaaatgcttacttaaaacagaccgcacttttgaatgccacgcttatagcgaagcaagaattatgaatggcttattatggatattattgcaagaaatgaacggcaaacaagcgactcaattggcagaatttgatttaatccaatatttcgatgaactcggcattgcccaacgtttaaccgatacaagacttaacggcttaaaacaaattgagcaaaagataaagttaatgccttaagacggtatacaatactactcaaacgttaacattcacatcgaaaaatacaaatttgttgatgaaaatctatgcttatgcaactcatctccttgaagaagagaaaaaatagacgttaggtaagatttacaaggcaaaaggcttttaaattacttttttacttgttttttgctttgtaaatactctcaataaacttgctaaatttattttaattactcaaaatatacttaatgaggtgtgacttgttttgatgaaaaagcaaacaagtcaagagatgaaattaaagcagttattgatgaaattttagggagtgaataatgaaattaccaatgcaatctaaagaagcaactaagtttgttaaagaaacgaataatggcgatttaaagcctaaatctaaagtttcctctattcttctctccgagaaacaaaatcaatttgtaaaagattacgttcgacggtgaagatattagcccatttcttaaagaatggattgagctatactctgaacacttgaaactaaaaatgaaaaatatattgctgcttgtgctgattcattatgccaagcataatactaaatttgatgttgatagtattttatagctttaaattgcttgcaaaatacttttattttacttttatattactttttatcttttagcaaagatgaaattatgaggagaaaatttatgattactgaagaagagaaattaagtagaaaaaaagctgttcaatctgcgattgataataatcgtttagaggggttagagcctagtaaagtttttattgatattgctcaaaattgggtcaatggaaatttgactaatgatgaatttggaagaaaagtttatgaaatacacgggcttcgattcccacattgatgaaaataaagtcttaaaaaatcattttgggattaaagatcaaaataagctagatcaaatagaaagagatattacctcttacaaagaatctattcttaacgataatccaataaaaggaaaatttgaccttaagcatttacaagatattcacaaacatttatttagcgatatttatccttttgcaggaaaaattagagacggctatttgcaaaaaggggagcaagatttcactatgggatatagaattgttccacaagctgaaaaattgtttagtgagctaaaaagtgagaatttcctaaaaaatactgaacccgataagatggctggacgcttagcttattatatgggcgaaataaacgctatacacccttttagggagggcaatgggagaactcaaaggatatttatttctcaattagcaaaagaagcaggttttgaattaaactttaataaagttagtcaaggtgaaatgataaaggcttctattcaggctcatagatgtgattatacagccttagaatctattattgaaagggggttgaaacctcttttttcaaaagttcttgatgggcttgctactcataaaccaacagtaaatcaggcttaatgtggcattctcatcacctttgctacagtaggggcgaatcacattcgccccatgacatcaacccgaacggagaataaaatacattaaarggcggatgtaatctgcccctccccttgtttctttaaattgccatcaatgcggatatttaagtttgaagttgtcataatttaagctcacattgtagataaaaagcaaattacattacatttacatttcattataatttaaatataattagaacccactttaaatagcgtttaaatgtcattaactttggaggtttattatggattatacaaattttaatatgcgacttgataacgacttgcgtggacgggcttatcctattttggagcagtatggattgacgccaagtcaagcggtaagaatgttttttaatcagattgcacaaaccggtaaaatacccttgtcgtttgattgggcggaaaatcaaactttaaccccaaaagcagccgcacggttacgccaaactgagcaggaattcgccaatggcgaatttgaacgcttttatagcctaaatgaactcaatcaagcgataaaggagatctcgcatggctaaacgcaaatttgatatggcaaaatcttttaaacgtgatttgagaaaacattacttggctttagtcggcgaagcatgggcagagatttcaaactgtcttttgaatgacttgccaattcctgaaaagtatcaagatcacccgcttaaaggcgataaatcaggctttcgagactgccatgtcaaaccggatttagtgttgatatacaaaatcgttgatgatgttgtggagttacattaccttgatagccatagcgaaatttttggctagcctaccgctctttgttacaaaaatgtcaaaaaaaaccgctccgaagagcggttaaatttttgaggttttattatatattatatattagaagtaaacacgtaagcctgctgcgtaaaaactttctcttatattttgttctttttcatgcgctttaacacggctattagcaaattctgcgtatgcttttagatttttgttaaaggcatagtcagcaccgacgataaacacgttttgtactgctttttgatgctcttctannnnnnnnnnnnnnnnnnnnnnnnnnnnnnnnnnnnnnnnnnnnnnnnnnnnnnnnnnnnnnnnnnnnntagcacttctaaagccattacgttgccattgagtatatacattcaagacatccggtaatacttcatattttgcacccactaaaagataacgtgcagaacctacaaaaagctttttattttcagattgatacactgtttgaccatattcaacgcccaacgatgctggaccgaattctacttgcgttgctaaacgccaagctttatgttgattatcagttctagacttaatcacaccttccacatcattgttattacgaaccgtataaccggcattggcatttaccttaatatcgccgaaattaccggcatagaatgcagaaactccgtaagtattttttaacttaatatgttttttgtctgaatcctttccttgaatatcttttttatgtgcttcaccgaaaccataatcaacaccaaaacctaaagtttgaccttccgctaattggatatctgctgtacggaaagacaccactttatcaccagaagtaagcaagttgttgttgccgccaaagatataggtatgatcatttaattgaacatcatccgcagtggtattttgtttaccgaaagttactttaccgatatcgttatgttttaagcctaaccataatttagaaagtttgatatcgttaaaagatgtatctgcttttgaagcgtcacctaacccgaaacgaaccgcaccgattgcttttaagccgttttgtacttcatgctccgctttaaattccacacgagatccgttattacgtaaatcggtacgttgagcatcaccgaatttacctaacattacatcaacacgaccgccaacttctactttggtaccgttttgattataaacagttgttgcgtttgctgatgccgcaactgccgctaccgctaatgctactaatgtctttttcataataaaattcctttcaaatttaaattattttactactgaattgaacctttccatatatgaaaagtccaagccaacttttaaaaaaaagcgagcctatattggcaaagaaaccgtttacagtcaactaaatttaataaaaaaatgctaaatttagtgatctaaatcacactttttgaataatttttgaactttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatttttttgctcagttgaacctttagaaaactactttcataggcatgtttctcaagatgtaaaaaaagggcttgcaaagtgttttgtgcttataaacgaacaacaatccaggattgttggctgttacactttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttttagtggtattcagttccgacaatcggtttgattttttcccatttccgacaagatgggcaattccatgatagtttgtgtgtttggtaaccgcaatgactgcaacgataatcaaagcctcgtgcaattctatctcccacgattttgtgcaataaaatcaaactttcttttgctttgccgttttcagcagcatcaatttggtattgaataaaacgatgtaaaataaatgtacttgggttttgttccagttgttggtgtaatttagtttgtgccgcaacaatgccgtctttttctgcgataagatccgataaagctaaatcaaccgcactattattgccggtttggcttgcccgaataagaaaaagttcaaagttgtctaaccgatttaattcttggtagcaatattttaatgccggtaaaatttcgctcatgtaatccgcattttgtgttagcacattttctaaatgttgcaccgcacgttgatattctaaattcacaatataacgttcagcaatgaggatagaggctctaacactcgtttttgaaacattcaacgcttgttgcaaaatatggattgcttgagcttgttgttgctcatcacttcctaaagtcagggaatattcgcagtagtaatgtgctaatgcaatgttatcttccgtaggcgaaattttggcaagtttctcggcaacattgatcgcttttttccattcttttgttttttgataaatgacggctagttgttgtaaagcattttcagcgtagttcggttcgtcaatcaataaaatataaagattttcagctcgatcataaaagcctatcgtcaaaaaatcttttgctaattgttgtttagcaagaagtttttgttcgaaggtataatttgaactgctatccaatgcttgatgaatacgcaaagctctatcaacttcacctcgagaacgatataaatttcctaaggtcaattcagcctcaaattgtgaacctgtttcaatgttattttcttgttcctgcttttgtagaatatcaaggaagagatctgccgctttttcgtgttgattagataataataaattaatacctgttacataatcacgagaaaatttattgctaatcgtatcttgatcttttcttgcactacgatgccccatataccagccgtaagctgctgcaatcggtaaaagcaggaaaagtaattcgagcattatacaaccttactctcgatttttgtttaattcatcaattaacgctaattgatgctttacttggcgagataaaaaaagattttttatttttaatttgatatagaagaaagcggtaattaaccaacctaaaagcagacctagcccaaacaagatagccactaaagttgataaacgtatttcattttgtgcaactacataattaaaggtaataatttgatcattgttagcaccaatagttacagcaactaaaacaaccgcaatcaataaaacaagacctataatatatttgatcatctctatctcctataactttctatttatggttaaactgattggaatcgctaaaagctcggtcattatgccaaaaaaataaaaaaaacgacactttacgcgtcgtttttttatattttatattacgagtaaatattaacacgctctttcagttctttaccggctttaaaatgaggtacatatttagcacttaaatctaccttttctccggtttttggattacgtcctattctagattgacgaaaatgcaatgaaaaactaccaaatcctcgaatttcaattctttcaccgttttctaatgcttgtgataattgttctagaatgtcttttactgcattttctatatctttcaaaggaacgttaagattggttgatgctaaattttcgataagttctgactttgtcataatatactcctagtgccggttggcataaatcctataattcatgccaaccaaaaagtgaatgaattattcaccttttgccgctttaaatgcttcagccattgcatttggaataacaatttcttctttattcacatttgcaactgccgccgcttcttctgcttggtcttttgctttaacagatagatgaacgatacgagatttacggtcaacaccggtatatttcgcttcaacaacatcaccaacaacaacttcattgctcaaatcagctgtacgaatatagccttcaacgccacttactaattcaactttagcaccttttgcgtcaacttcaaccactttagcactgaccacagcaccttttttgtttaccgcaatgaaattattaaacggatcttcttccagctgtttgatacctaaagaaatacgctcttttgcagaatcaacttgtaatacaactgcttctacttcgtcaccttttttatagttacgaacagcttcttcacccggaatattccaagaaatatcagataaatgtactaaaccatcaattccgccttcaagaccgatgaaaataccgaaatctgtaatagacttaatcttaccggaaactttatcacctttgttgtgagtttcagcaaactgtaaccatgggttaggtttgcattgttttaaacctaaggaaatacgacgacgttcttcatcgatttccaataccattacttcaacaacatcacctaaatgaacaactttagatgggtgaatatttttatttgtccaatccatttctgacacatgaaccaaaccttcaacaccttctaaaatttcaacaaagcaaccatagtcagttaagttagttactttacctgttaatttgctgttcaccggatgattttctgcgatggctacccaaggatcttgacccaattgttttaagcctaaagatacacgtgttttatctttgtcaaatttgaggactttaactgtaatttcatcgccgacacttacaatttcacccggatgtttaacacgtttccacgccatatcggtgatatgcaataaaccgtcaacaccacctaaatcaacaaatgcaccgtaatcggttaagtttttaacagtacctttaacttctgaaccttcagctaagttagctaaaatttcttcacgttcttgactattttccgattcgatgactgcacgacgagataccacaacattgttgcgtttttgatctaatttaatgactttaaattcttgttctttacctaataggtgatccgcttcacgagttgggcgagtatctaccaatgaaccaggtaagaacgcacgaacaccgtttaactcaactgtgaaaccgcctttcactttaccgttgattaaaccgataacagttgcttgttcttcgtatgctttttctaaatcaatccaagattcttgacgtaccgctttttcacgtgaaagtttagtttcaccgaaaccgtcttcaacagcgtccaaagcaacgtttacaacgtcacccactttaacgtccaattcaccttgagcattttggaattcttccgccggaatacgagcttctgatttcaaacctgcatctacgtacacgaagcctttttcgatagcaacaacagtagcgttaacgattgaacctacacgagtttcaaggtcttttaatgattcttcaaatagttgagcaaaagattctgacataattaatcttctaaatttaagttaataacgaccactttaatttccataaaaagtggggctgataataaatgtttattcaatccttgaataaacgagttcagattccaacggagagttcatcacacgactgatatgctctaatgcttgtttgatcacatcatcaattgttaattccgtgctatcaagtaataaagcatcttctgcgggcttcaagggagcgactggacgatttctatcacgaaaatcacgctcttttatctcggtcaaaatctgtgcaaagttaccattaattcctttattttgcaactgtttatgacgtctttttgctctttcttccgcactagcatctaaaaaaatttttacttgagcatgcggaaataccactgtccccatatcacgcccatctgcaataagcccttccccgtttgcaaaatctcgttgtaattgcaataacgctgttctaacttgtggaaacaccgcaatttgagacgcagcttcagccacttcttgtgtacgaatttttgtactaacattctcattttgcaaaatgatattcacttcgccatgttgtggaataaattgaatgtcgagactacgggctaattcagtcagtgccgtttcatcatcaagtgccacacttttttttaacgctgccaatgctgtcacacgataaattgctccgctgtctaataatcggaaccccagtttctcagctaaggcataacatagtgtacctttgcccgctccacttggtccgtcaacagtaataatcagatttttattcataaattgaaccttgatacaaaaatgcgtcatatattatgacgcactttattttttattcggctaatttcttctcaacagccttcaatcgcttgtttattttatcaatatctaaagttaatgcggcagttttacgccataccttatttggctgtaacggaattccggaagaatatattcccggttctgtgattggtcgcatcaccatacccattccagtaattgttactttatcacaaatttccatatgcccattaataacacttgctccgccaattaagcaatagcgaccaactttcaaactacccgccataataacaccgccggcaacagcagtacctgttccaatatgaacattatgtgcaatttggcaaagattatctatgattacattatcctcaatcacagtcgcatcaagtgcacctcggtcaatacaagtgcaggcaccgatttcaacatgattgcctataatgacagttcccgtttgtggaattttaatccagcgaccacgatcatttgcataaccaaatccatcactaccaattaccgcacctgattgaatgagacaatctgagccgattttaacgtcatgataaatattgacatttgcccaaagctgggtattttcaccaatctgcacatgcttaccgataaagcaacctgcaccaatcaccacattgtcaccaagtataactccgtcttcaatcaccgcattagccccaatggaaacatgttgacctaacgttgctgtgtcggaaacgaccgcactttggtgaatgccttgagccgctttaggtgtgctgtccatatattgtgccaaaatagcgtatgcaacataaggatcttttactacgagcaaattactttgtgcagaacagaattcgatatcactttcggttacaattaatgcaccggcttgtgattgaagcaaatgttctcgaaatttaggattggaaataaaggtcagttggttgttatccgctttatctaaaggtgctatgtccgttacaataacatcggcgttaccacgaatggtagcgccgatttgttgagccaattccagtaaagaatatccttgcattacttagcctttgcaggagctggagccggaatagcttttagaacttcctcggtaatatttttaccgtcagcaacataaattgccgttttttcatccaatacaattgtaaagtttttggctttagctacattcgttgtagctgtttgaacctcttttaataaacgttgagtaatttcggcatcacgtttttgtgcttcagcttgaaacgccgcaacatttttttggtgttccgctaccagcttgttaaactcgtcattacgttttgttaccaatttagcaatttcatcttgacgttttttgatatcagcttgacgtagtttcggtgcatctttttccaatgctttactttttgtttcaatttctttttcaaaattgtcacgtttttcaactaatgctttatctgctgcttccagtttttctgctggtgctttaaattcctcatttaatttttgaaactcaagcaagcgagcagggtgatttaaaaacaagtactctgtattaacaacagcgatattatcacttgccattgcaattgatgagcctaatgcgatagaaagagcggtcagttttactgcatttttcattgtttgaatatccttaataaattaattttaattgagttccgtacaatttaattatacgggtttcatatcagactattaattatagccgaaagttccctaaaaagaaccaccaatactaaattggaattgttcaatttggtcaccttgatattttttcagtggtttagcataagagaatactaaaggtccaatcggagaataccattggaacgcaatccctgctgaagctcttatacgagctgggttcccgtagtcaggtatatttttatctctagcaaatggtttaccatctgatttccatttagtattccatacagaaccggcatcggcaaagatagaggttctcactgatcgttggtttttctctgctacaaacggcgtcggaacaataagttcaatacttgccaatgtcatggcatttccgccaacaatatctttgctatggcatgtatattggttttggcttgtactttgcatacctccagccgcactgttttgcattgcactacaatttccattcccctgataaatcgcttttggtcctattgcaccatattcaaaaccacgtacagttcctatgcctccggcagaataagtttgataaaacggtaaacgtttaccgccaaaaccgtttgcatatgatcctgacaatctacctgtcagtacccaataatgatcacgatccaatggataaaacccctgcacttcagcactcactttatagtatctgttatctgaacctgggattgttactttaccgccaacattcgctcttactccggaggtaggcaaatagccacggtttaagctgttatagttccaaccgaatgaaaattcaaagtcgtgtgatttaaaattccatctattagaatcaggataccccattgatttgcgatataaatcacgattatattctttcgtcacattttttaattggctataaatatgccctaaacttaaataataggagttattttcattgaccggaaaacttaaatttccacttagaccgtaagttgtacgtccataggcggctgcagtatcactttttgagttatcgtgtttttcaaaaaatgcgtttccacctaaacttacaccatctttagtaaagtacggttcgttataacctaaattaagacttgtgccataattgttgcgtgaaccggctaaactaatcgaggaacccatgcccaagaaattatcctgtttaatacttgcctgataacttataccactttcagtaccataaccaataccgaagttaagactccctgtattgcgttctttgactcgataaatgacatcaacttggtcgttaatttgttgattggtttgagtttccgtttccactgactcaaaaaatccggtacgctctagacgaattttccctaactcaactaattgagatgataaccaagcaccctcttgttgacgcatttcttgacgtaatgtgctatcggcagtaatcgtattcccctcaaagcggatttgacgaacagaataacgatgtcccgcatcaacaacaaacgttaaatcaatcgttttgttctcttcattaaagactgaactaacatctacttttgccgttgcatagccttgctcgcttaattttgcttttatcaattgttcaacactgctaacttcactacgacggaaagtttctccgacataaatgtttttaagcaacggtgctaactcttctgacataccgcctacatcaccaacgattcggacactatttacagaatacttattaccttcgttaacttgaattctaactctaacctcagttttttcgtcatttagctgaacatcagtaccaacgatttgaaattttgcataaccatgttctaaataaaaatcacgaataagatccaaatcttggttaaattgattggtatcaaatttattcccaaataacttccaccaagcatccggctgtaattccatccgctcttgtaattggctactgctaaatgcttcattgccctcaaaacgcacttctttcagttttgccacatcactttcttttattttaagttttacttctgctcgatcatttgataatggattaacaattgcctctacagtcgtattataacgaccgacagactgataatgatcaactaaacttccacgaaacgcttccaatttttctcgatttaaaatatcaccgctagcaaatccgttcgctttcaagttttctcgtattgcttcactaggaatagattcatttccctccactttcacttccgcaatcactaagcgtggtactacagaaatgactaaggtatttccttcacgaacagcttgcacattatcatagccacgcaaaaataatagtcttacgacatttgaaatatcactctccgttgctttttgtccaattcgaaccggcaatccagataacaccgcactttccttacctgcttgaataccgtttatacgaatatcttgcacgacaaacggtgcggcaaccagaccagtcgagccaaataataggcttgcaattaacagttttttcattgttagttctatcctctaataaagaaatatctaagagtctgtttatcgattaaacaaaatcctgacgattataaacgtaaaaaatcattaaacaatacaaatattgttaatatcaataataatcccgcaccaattttatacgcaatattttgcatttgctcagataagggcttacctttgagtgcttctatggctaaaaaaagtaaatgccctccatccaataccggcaatgggaataagttcataatacctaaattcacactaatcaacgccataaagctgagatagtacacaaaacctatttccgaagatgccccagcacctttagcaatggaaatcggaccacttaaatttttagctgaaaactctcctgtaaacagcttaccgataatttgaatagttaatttgctcaattgataagttttctcaataccttttataaacgcctcaaaaaaaccatattttaattctgtgcgatattcatcacttataggataaatagtcggtgcgacaccaacgaaccatttccctttttcatttaagtgcggtgtaatcaccttatccagccattctccatgacgtaatacttgaacattgaaactatcccctttatcaacaaaactgataaaatcacgccatttcattggttcattttgataatagatttgatcaccaattaataaccctgcccgttgtgctggagaattttcaacgaccttagacagtgtcatctcaattttagttcttaccggaacaatccctaatgcaccaaaggccgtttctttttcaggatcaaagttccattcagataaatccaatacttttctttgctcgatatttgttgttgaggacttcaaaagtgttagcgtaacgctttcctcccccatttttgtagcaagaaccatattgatactttcccaatccggtgtcgatgtcccgtcaattgccataatttgtgagtaaggttcaagccctgccttctctgccaaagattgaggaaccacattttcaataacaggtttaatactggggataccgatagaataaaccgtcaaataggctaaaatcgcaaacagaaaatttgctataggacctgccgcaataacaaaagcacgttgcaaaatggatttattgttaaaggcttgtgattttaagttgtcaggaacttgttcattacgttcatccaacatttttacatatccgcctaaagggattgcggacacggcaaattccgtgccttgtttatccactttagaccacaagactttaccaaagccaatagaaaaacgatgaactttaataccgcactttcgtgctgcccaaaaatggccatattcatgtactgaaaccaatacaccgataacaatgataaaagaacctaaagaccaaagaaatgacataataatctctacaagaaataaaaatagaaataagcaaaaaacggaactgccgccgttaaactgtcgatacgatccaatattccaccatgtcccggaataagttgactgctgtctttaataccgcactcacgtttgaacatactttccgtcaaatctcccactatggaaatcgctactgtagcaacagataaggaaataaaagacagacgttctaacacaaaaagatctgccggcacaagattaatgaaaagtgcggcgaaaatacccgcagtaatcaagcctccaaatgccccctgccacgttttccccggtgaaactttcggtgctaatttatgtttacccaatgctcgacctgcaaaatatgcacctgaatcggctgcccaaactaaaataaatacataaagcaatagcattaaaccatcgtaaggattagaaacgtaattgtccaaacgtaaacgtaatacagcgatgaaaaaagggatcaaagtgcagaaagcaaaaataaattgtaagaaagaggatttagcccaaatttttgccgaagcaggataacgaataacaaaaaataaggcgatgaaccaccaaattaccgccatcaataatacaggttcagcatagttttcaaacactctgccaactgttaaaaaatgtgcctcaccaaaaatccacaaaaaaataaaagccccaaacagccctgtaatcattaaacgccaaaaaaattgtttaacaccaccaaactgtgtccactcccaaatacctaaagcaacaacgacaccaagagataaagcaaaatagaaaggggaaaaccataataacgcaattaaaacaaccacaattaatacgatagctgataatattcgttctttaagcactactcttctccatcattccgaactgccaaaacgacgttcacgttgttgataagctaatatcgcttgattaaattcctgttcattaaaatcaggccacaatgtatcggtaaaatacagttccgcataagcaatttgccataataaaaaattactaattcgttgctcaccacttgttctaattaataaatctactggaggttgtgaacctgttgttagatgatgttgaaaaatttgttcatcaatctcatcaatatgcaatttattttcttttaccaattgtaccaattgacacgtcgcctgaacaatatcccaacaaccaccataattcgcagcaatatttaaagtaagtgcggtattattttccgttaatttttctgctcttttgattttttcttgcaaacgctcattaaattgagaaacatcaccaataatttgtaatttaatgttatttttatgtaattttttaacttcaatatccagtgtttgcataaataaggacatcaaagcacttacttcactttcaggacggctccaattttcactgctaaaggcatacaacgttaaaactttaattccgatttttctagcataagaaaccgactctcggacagccttaatcccatttttatgcccccaaatacgcatttttccctgttgtttcgcccagcgtccattgccatccatgataatcgcaacatgctgaggaatattgtttaaatttaatgctgttttcgtcattatttaatcgatttttatcgaagtgaaattcggttgcgactataccataagttgatacggcttgctatgaaaaggcaaataaacagaaaaaaaatcctcttttaatcggtaaaaaacataagtttagtcgtttagttttcaggcttaacaaataaaatctcaatgttttcatcattaatgcgttaaagctgatattttcttttatcgccaatatcaaaatgtaaaggcattctccatttttgaagagaaactataagaaaaagtaccgcacttacgaccgataaaatatacaccatataagtcaaattaaattgtaggcttaaccaaagtgtggcaacaaaaaatggttgtaaatttaatgcaaacacacggaaacaaaaatattctttgaatgctaatccccctaaagtcaacaatgctccgcccagtgcaaactctggtaaattaaatagttggcaaattaatgcagcccaagttgccatttgtaataacaagcggatattttttaaataaatatgcaaagaagatgcacataacgttgctgcaataagtataccgtaatgtgcaatttccggcttataaggtaaaagtgcggtcatgattgcggctaaagtgaaaccgcaacgatataaaataactgttagataatcccaatgatccataggggatttaatttgaggatctgccatattatgttcctgatgtacgtaaaacaaagctattagccaattctcttgcctgcttatctaccagcaatacatcttctatactggtaattacttggctttcaattttttctaataccgctgtgttaatttttgctatatccgtaaattttattctcttatttaaaaatgcctcaacagccatttcatttgccgcattcaaagctgttgttgcatattgtcctgctgagaaagcctctatagctaattttaaacaaggataacgttggtaatccggttttaagaaagtcaacccacttaattgataaaaatccaatggttcaacccccgcaaaagtgcggtgaggatatgccatagtttctgcaatcggtgtacgcatatcagggttacccatttgtgcgataaccgaaccgtcaatataacgcaccatagaatgaataatagattgcggatgaataattacttccatttcatcagcactggcattaaataaccagcgtgcctcaatatattccaaccctttattcatcatcgttgcactgtctactgaaatttttttgcccatagaccaatttggatgtgccactgcttgctcgggcgtaatatgttcaaacgctttcaaatctgtataacggaaaggcccccctgatcctgtcagtacaattttgctaattcccaattgcgttaatggacaaaaaccaatttgttgctgagcttgtggaggtaacgattggaagatggcgttatgctcgctatctaccggcaaaagttgagccttattctttcgtacttcatcaataaaaatcttaccacaggttaccaatgtttctttatttgccaataggatacgtttacctgcttgtacagcggataacgtcggcaataaccccgctgcaccgacaatagccgccatgacttgatctgcctcaggatgagcagcaagttcgcaaatcgctttttgtccgctcaacacttcagttttactctccaagaatgccaacttttctcgcaattttttcgctgcactttcatcattcattgccacaaagtgcggttggaattttataatttgctgtagcataagttcgacatttttaccgccaactaatgcaagaacttgatattgctccggattctttgcaataacggaaagcgtactggtaccgattgagccggtagaaccgagaatgacaagtttttgtttattattcatactattacaaatttatcaaatatataacaaaaaacgcagtaaaaactgcgttttcgctaaattaatcatattagaaatcaagcaattctttttctttgtcagccaaaatttcatctacttttttcacgaaagtatctgtgatcttctggatttcatcttgtgctttacgctcttcatcttcactgatttccttatcttttagtaaggctttaatttgatcatttgcatcacgacgcacattacggatcgcaattttaccttgctcaccttcgcctttcacgattttaattaaatcacgacgacgctcctccgttaatggcggaagaggaactcggatagttgttccagcagaagacggggttaaacctaaatcagatgttaaaatcgctttttctaccgcactaatcaaagaacggtcaaatactgttactgccaaagtacgtgcatcttcagccactacgtttgcaagctgacgtaaaggtgtcggtgaaccgtaatattccacttgaataccatctaacaaactaggctgtgcacgacctgtacgaattttagcaatatgtgctcttaatgtttcaaggcttttttccatacgctgttgcgtatcttttttaatttcgttaatcacaataattcctttaaaaataataagataagtttaaaatctgtgttaatttactactaatcgcaaattaacgtcccttctgttttacctaaaatgacattgtgtaatgcacccgttttgctcatgttgaatacacgaattggcatattatggtcacgagcaagtgtaaatgcggctaaatccataacttgtaattctttttctatcacttcagcataagataatttgtggtaaagcactgcgttgggatttttcacgggatcgcaatcataaacaccgtcaactttggtcgctttcaacacaacatcagcctcaatttcaattcctcgcaaacaagctgctgaatctgtagtaaaaaatggactgccggttccggcagagaaaatgactacccgtttttcacataacatttttatggcttccgaccagttgtatgtatcacaaatcccattcagttggaaagctgacattaatttggcatttacattagcacggtgcaacgcatcacgcattgccaaaccgttcatcactgttgcaagcattcccatgtgatcaccaacaacccgattcatacctgctttggctaacttggcaccacgaaataagttgcctccgccaagaacaactccaacctcgacacccaaacccaataaccctttgatttccagtgccattctatccaagatagacggatcaataccaaaaccctcgtcgccttgcaacgcttctccacttagtttaagtagaatgcgtttataaattggttggctcatttccttacccctttcaataacccagagacaaaatctcgcttattatagttcaacctgactggcgtgcaagtattcattgaaaaatacccttaattattttaaaccagttttaagtcaggattaatcttgaacgctaatttatttacacttggatactgacgttggatcaattgcaataaaggcgattgctgaaagaggaaagcttgtcgtacagttgcattaacgacttcaatccacatagtgtcagattcaaaattgataacacgataaaaccccttgaactcaataggaaataaatgttgtatttgttcatttaattcttctaaaagcgacgctttttgaatgatttgcatcaaaggggagttttccaataactcattgaaatttttcggcttactgtatctcatcttgattttccaagtttcgtcctaatattttatacagagttatgacattgtaacgaatttccgttacaatacgcagaaaattttgtggtaatgtaaaacaatgattttaattaaagggaaacagtatttttggtcgcaactgctattaagtgtcatagcgttctttactttacccgttgcacaggatatagctccacaaaagattactaatgattacccaaaaacacaaaatgtaatacagcaactttactataccgcatcaaatattcaacaagtgcaacagcaacaattacgacaaattcgttatgttgttactgaatcatcaattccttttcaatttgtaccgctctttttagttggacaattcagtcatctcccccctattcgtgccggtccgtaaagaaattaaatttaaatttatttcagtgccaaatattattaggcgaatttgtttattcaattataaaagaaaaatactatgttaagaactattgttacaaaaatctttggcagtcgtaatgaccgcattttacgtcgtttagctaaacaagttaaaattatcaataaattagagcctgaatttgagcgcttaaccgatgaagaattaaaatccaaaaccactgaatttcgtgcaagattgaaaaatggagaaaaactggaaaatttaattccagaggcatttgcaaccgtgcgtgaagctagtaaacgtattttaggcatgcgtcctttcgatgtgcaattaattggcggtatggtgttaaacaatcgatgtattgcagaaatgcgtacaggtgaaggaaaaaccttaactgcaaccttaccttgttacttaaatgccttaacgggaaaaggtgttcatgttgttaccgtaaatgattacttggctcgccgtgatgcggaaaccaatcgccccttattcgaatttttaggtatgactgtaggcattaatgttccgggtttatcaccggaggaaaaacgtgccgcctatgcagcagatattacttacgcaacaaatagtgaattaggctttgattatttgcgggataatcttgcacattcagctcaagatcgctttcaaaaacacttacattatgctttagtagatgaagtggattctattttaattgatgaagcccgtacgccgttaattatttccggtccggctgaagacagttccgagttgtatatggcaatggataaactgattccaatccttatccaacaagataaagaagatactgaagaatatcaaggtgatggggactttacactggatctgaaaaataaacaggctcatttaaccgaacgtggacaagaaaaaattgagcaatggttaatggaaaaaggttttattaatgaaaatgaaagcctctactcccctgctcgtatttctttattgcatcatatttacgctgccctacgagcacacaaactatttgagcgtgacgtagattacattgtaaaaaacggtgaaattgttattgttgatgaacacaccggtcgtacaatggctggtcgtcgctggtctgatggcttacatcaggcaattgaagcaaaagaaggcgttcaaattcaaggagaaaaccaaaccgttgcttccatcacttatcaaaactatttccgtctgtatgaaaaattggcaggtatgacagggacagcggatactgaagcatttgaatttcaacaaatttatggtttggaaaccatcgttatcccaaccaataaaccaatgattagagatgatcgcactgatattatgtttgaaaacgaaaaatataaatttgatgcgatcatcgaggacattaaagactgtgttgcacgcaatcagccggtattagtaggtacgatctctatcgaaaaatcagagttactttccaatgcactaagcaaagcaggtatcaaacataatgtcctgaatgccaaattccatgctcaagaagctgaaattatcgccaatgcgggatatccaagtgcggtcactattgctaccaatatggcagggcgaggaactgatattgtactgggcggtaactggaaagctgaagttgctaaattggataatccgacggaggagcaaattgaggcaattaaagcggcatggcaaattcgtcatgaaacggtaaaacaagccggtggattacatattatcggaacagaacgccatgaatcccgccgcatcgacaatcagttgcgtggtcgttcaggtcgtcaaggtgatcccggttcttctcgtttttacttatccttagatgatgctttaatgcgtatttatttaacagaaggtaaattaaacttcatgcgtaaaatgttcacagaaaaaggtgaaggcatggagtcaaaaatgctggcgaaagtgattgctcaagcacaagcaaaagttgaagcacataactttgacggacgtaaaaatctgcttgaatttgatgatgttgcaaatgatcaacgccatgcaatttacgaacaacgtaatgctttactggataatgaagatattgccgacactattcaggtcattcgccaagatgtcttcaatcatgtcattgatgaatatgtcccgccgcactctttggaagaacagtgggatattcctgcattagaaacccgtttgaagcaagactttgctcttgatttgccgttaagtaaatggctggaggaagacaatactttcaatgaagatgtattacgtgaacgtgttttagcagttgctatttctgaatataaacgcaaagaagaattggtaggtcacgaaactatgcgtaattttgagaaaggcgttatgttacaaactcttgatgaactatggaaagagcatttatcggctatggatcatctacgtcgaggtattcatttacgtggttatgcacaaaaagatccgaaacaagagtacaaaaaagaatctttccaaatgtttactgacatgttagatacattaaaactaagcgtcattactacattaagccgagtacaaattcgtactcaagatgaagtagaaaaagcggaacaggctcgtcaaaaaatagctgagcgtgaaaatgccgcaatgcaataccaaaataatgaaggaacatcatcacttcacgaaaaatcagaacataagataggacgcaacgaatcttgcccttgtggttccggaaaaaaatataagcattgccatggtagcaaagcaaaatattaattaatatggcggtggaaatttccaccgcactttttaggataaaaccatgataaaaccaacaatccaagttgccgctggcattattcgtaacgagtttggacaaatttatctaactcaacgactagagggacaggattttgctcaatcattagagttccccggtggaaaagtggatcaacatgaaacacctgaacaagcactggctcgtgaattagaagaagaaatcggtattcatgttctaagtgcggtgctttttgaacgtttttcttttgaatatccaactaagattattcaatttcatttttatcttgtcgaacaatggattggagaaccgtttggacgagaaggccaagaaggtatgtgggttgatcaaaatgagcttgatgacagccaatttcctcctgccaattttaaacttattcaacgattactagcagaaaaatagcgataacaattatcttctcgttatatcagctttataatcgtatacaaacaagagggcatttacaaatttagcattttacgtccgcaataacattcaaaattcttttatctgatataggatatttagtgcctagttgttgagcaaataaactgactcttaattcctcgatcatataaggaatttctttaacttcactcgagtgcggtttagatttcggcagttttgctaaaagttgttggtacgcatgactaacctgttctactctgagcattgcagcacgatcacgattaatatcttgtgctaatttatcaatacgcttatcaattgcctgtaaataacgctgaatatcagacaaacgcccataacctgttttcgttacaaattccggataaataagtccattcatttgtttttttatatcagcaaaagcaaatgccattgtaaaatccatttttcctttcaggcgttgattgatttcaaaagtcaaggtcaggattttttcaacttgctttgcaatttccactgtaacctcattcagattttctcgaataaaatcacgcaatctctcaaaatcagtttcattccaaaccaaaccaccaaaatcagcaataagtttatccactgcacaagcaatgcaatcatcaattaaatctaaaactcgtccgaaaggcgtaaaatacaaacctaacttcgatttgttcggcaatttttcatgtaaatatttaatcggcgaaggcacatttaatagcaacaaacgacgtaatccttgctgcatagtaacttgctgttcaagctctgtttcaaatagcttaatgccgactgaatctttttcatcaacaatagcaggataagccttaatgctaaaaccttgttttttctgttcataaaattgcggtagtcgagcgaaattccaaacatgaataccgctttgttcaataccactatctgcaacgcaggaaatacttttttgcactttatcttttaggctaaatttcaattgatctaaatcaaggctttcggcaattttgcctcccttttcatcaatgaccctaaaggtcattcttaagtgcggtggaatctgtgctaaattccattcttcaacttcaatctgaactccgctcatacgacgcaattcatgactaagcgtttctagcaaaggtttgtcggtttgcgttattcgacctaagaaagcactggcatagttaggtgcgggtacaaaattacggcgtaaagatttaggtaaagatttaattaaggcaataactaattcttggcgtaatcccggaatttgccaatcaaatcctttcatttcaacctgatttaatagtggcaatggaatatgcaccgtcacaccatctgcctctatacccggttcaaattgataagttaattttaattttaaattgtcttgataccaaaaattggggaaatctaatttgttgatattggcattgtcttcgttcatcagaaaagacttttcaaaattcaacaattcaggttcttgttgtgcttttttcttccaccaactatcaaaatgtttttgtgaaacaacatcggtaccaatccgttgatcatagaaatcaaataaagcacgctcatcaactaaaatatcccgacgacgtgttttatgttccaattcttcaatttccttaattaatttttgattggcaaaaaagaatttgtgtcgggtattccaatttccctctactaaagcggattgaataaaaatttctcggctggtaacagcatcaatagcaccataattagcaagcctattagttacaatggggataccataaagactgactttttcatttgcaatcacttgtcctcgagactttgaccagcgaggttctgaataactggatttaatcaaatgtttcgctaacggttcaatccattccggctcaatatctgccattattcttccccaaagtttagaggtttccactaattcggctgctacaacccatttaggttgttttttaaataaaacggaattggggaaaatagagaaatgtgcatttcttgcccctaaatattgctgtttttcattttctttcaatccaatatgggatagcaatccacttaaaagtgcggtgtgaatttgtgcatattcagcctcatgagaatttatgggcaaccccatttcacgcacggttaaacgaatttgatgataaatatcctgccattcacgaatacgtaaataatttaaatactcttttcgacacaagcgacgaaattgatttttgcttaaaattttctgttgctcttgaatgtaattccacaaatttaaataagctaaaaaatctgattttttatcagcaaaacgacgatgtttatcatccgcagattgttgtttttcttgcggtctttctcgaggatcttgaatagataaggcagcaacaataatcatgagttcatgtaaacaagaaaattgtaccgcacttaataacattttagccaaacgaggatcaacgggtaattgtgctaactgcttaccaatagcggtaagctggcgtttctctccttgcttgttttttttccattcaaatgcctgcaactcctccaagagcttcataccatcttggatatgacgtttatccggggcatcaacaaaaggaaaagcttctatatcatctaaacctaaagcggtcatttgcaaaataaccgatgccaaattggtacgaagaatttcaggatcggtaaatgccggacgattattaaaatcatcttccgaatacaaacgaatacaaatcccttcagacacacgcccgcaacgacctttacgctgattagcggaagcttgtgaaattggctcaatcggcaaacgttgtactttagtgcggtagctgtaacgtgagattctcgccgtgccgggatcaataacatattttatacccggtacagttaatgaagtttccgctacattagttgccaacacgatacgctttaaattactcgggtgaaaaattttattttgttcttgtgctgaaagacgagcaaagagcggtaagatttctgtatgttttaaatctaatttttgtaatgcttctgccgtatctctgatttcccgctctccatttaagaaaattaaaatatcaccgactttctctgcctgtagctcttctaccgcatttaaaataccttgtaactgatcttgatcttcttcctccacaattggacgataacgtacctctacagggtaagttctaccggaaacttctataatcggggcatgattaaaatgttgagagaagcgttctacatcaatcgtcgctgaagtaataattacttttaaatcaggacgctgaggcaacagctgttttagatatcctaaaataaagtcattgtttaagctacgttcatgtgcttcatcaataataagtgtatcatattgatttaaaaaacgatcagattgaatttctgccaataaaattccgtctgtcattaatttaatttgtgtttcatcgctgacctgatcatgaaaacgaactttataacccacgactccaccgagttccatatttaattcttccgcaattcttgcagctacggaacgtgcagcaatgcgacgaggttgagtatgtcctatcaatcccttctgcccaaaacccaattctaaacacatctttggtaattgagtggtttttcctgaaccggtttctccagcaataacgactacctggtgttcccgaataagtttctggatttcagcttttttttgattgaccggcaaattttgtggaaattcaattttttgtaccgcactttgtcgttgtaaaaaacgaaagtgtgcctgctgaatttgctgttcaatttccactatcaccttgttgatattcgtaggatttttaagttgattcatgcctttgatacgagcaagcaaacgacgccggtcaatcgacatcatgtcgttaagctgtgccaataatgtctgctgttgtgtgctaaaaacattttttttattattcttcattattcttatattcaaatttagtcaatcatgtaacgctaaaaattatttatcctgtttttccaataaacaaagacaaaatccctgcggcaattaacggtccaacaggaacaccccctaaaaatgcgacacccaaaatagtacctactaataaacctgtgagtagcgaaggttgcgtccccattaaattcacaccacgtcctccaaaccatgcaacaagcacacctaccgccatggctaaaaacattttccaatgaataagtgcggtccaattcggcaactgaaccttgcctgaaacgatgggactaagtacgccaatggtaagaataataataccaatattaactccatacttttccgtaaaaggaatatatttggctaaaaatgtttgttgcattaaaagtaaaatagttgcggaaatggttatggagctattattgcctagtacaccaagcaaaataaggctgactaataataaagcaattgagttaaactgtaacgacattgaaatattcctaacggataattaattctcataaaacggtgctaattatagcaattttctacatgcttgcgactttttcgttatcaataaaaaagacattacagcaattatttaacaatattttaataattaaaaaacatctaatttacttaaataaaatttaaaaaataaacaatatattaaatataatttcaatttttagggtaaattttatttttttatattttaaaataattctatttgacctttcaattatttttgggtatatctaccccatcaaataaatttgtcatctttttaagtgaggatcttatgccccaaaaatactcaacgctaaaaaataacataaatatgttaggccactttttaggcgaaacaatcagcgatgcacagggtagtgatattcttgatttgattgaaaatattcgtgtattatctcgcgactctcgttccggtgatgaaaaagcacgggaaaaattattagatacgctttcgactatttccaatgaaaatattattccagtagctcgtgcttttagtcaatttttgaatttaaccaatatagcggaacaataccaaacaatctcacgaaaacacatagaccaagttgcctccgatcgttctttagaggcactctttgaacgcttaaaagcacaaaatataccggcagaaaaagtcatctcaacagtagaaaaattattaattgaattagttttaaccgcccatccgacagaagttacccgccgttctcttttacataaatatgtagaaattaaccgctgtttaagccgtttggaacacgatgatcttactcaatcagaaagcacaaaattaaaacgccgtttaatgcaattaattgcacttgcttggcatacaaatgaaatccgtacgcaacgccctactcctgttgatgaagcaaaatgggggatagcggtaattgaaaacagcttatggaaagccgtgcctgatttttgtcgtcaattgaatctccatttagagaaaaattttggtgtacaacattcagtaaacttagcacctgtcaaattttcttcttggatagggggagatcgtgatggtaatccatttgttaccgcagagacaactcgccaagttttaatcatgaaccgctggaaagcggcagaattgtttttagcggatattcaagttttatcagaggaactttctgtagttcattgcactgaggaattccgtgccaaatacggtgatcatttagaaccctatcgtgtagtcgttaaaaatttgcgagcaaaactggtaaaaactgtcgcttattacggtgaaattttagaaaataaaccttcaaccatcaatacaaatgacattttgaccgatgatcaacaactttgggagccactttacgattgttatcaatctttacatcaatgcggtatgcgaattattgctaacggtatattgctggattgcttacgtcgtattcgttgctttggtctctctttgtctcatttggatattcgtcaagaaagccttcgtcatactaaggctctctctgaaattactcgttatattggtttaggcgactattcacaatggatggaagatgataaacaagcttttttaatccgtgaattaagctctcgtcgtcctttgctacctcgcaactgggcgccttctccggaaacgcaagaaattttagagacttgtcgagttattgcacaacaacctgaaggcgttatatcttgctatattatttctatggctcgcactgcctcagatgtgcttgcagttcacttattattaaaagaagctggcgtaacctattatttacccgtagttcctctttttgaaaccctagatgacctcaatgcttctaaagaagttatgactcaattatttaatgtaggctggtatcgtggtgtgatcaacaataaacaaatggtcatgattggttattccgatagtgcgaaagatgcaggtatgatggctgcttcttgggcacagtatcgagcacaagaacaactggtaaatctttgcgaaaaaatgggagtagaattaaccttgttccatggtcgtggtggtactattggacgtggaggtgcacctgctcatgccgcacttctatctcagccaccccgctcattgaaaaatggcctacgtgtaacagaacagggagaaatgatccgttttaaactgggtctacctgcagttgcagtaaatagctttgatctttatgccagtgcaattttagaagccaacctgcttccacctccggagcctaaagaaagctggcgtgcaattatgaatgaattatccgattcatcatgtaatatatatcgtagcgttgtacgtggagataaagattttgtaccttatttccgttccgccacacctgaacaagaattatctaagttacctctaggctctcgcccatccaaacgtaatccgaacggtggggtagaaagtttacgtgcaattccttggatcttcgcttggatgcaaaatcgcttaatgttaccggcttggttaggtgcaagtgcgtctattcgtcaatcaattgaaaaaggcaataaagaaaccattgaagaaatgtgtaaaaattggccgtttttctctacccgtatcggtatgttggaaatggtgttcagcaaaactgatacgtggttatctgagcattatgatctgaacttggttaaaaaagaattatggtatttaggtcaatctttgcgtgaacaactgcaagccgatattaaaactattctttctttatctcatgaagatgaattaatgtctgatttaccttggattgcagaatccattgccttacgtaatatctataccgatccgctcaacttactacaagtagaactgttgcgacgtttacgtgaaaaccctgaaaatccaaatcctgatgtggaacaagcattaatgattacgattacaggtatcgctgcaggtatgcgtaatactggttagtgatgaactcatcatacaaaagtgcggttaaaatcaccgcacttttttctattcctaacttttatgctatgatgccttcgcctttacttataggaagatatgatgacagaaaaatttaaaaaattagctcctgatacagcaattgatattgcttatgatatttttctcgaaatggcgggagaaaatcttgatcctgccgatattcttttatttaacttacaatttgaagatcatggcggagttgaatttgttgaaactgccgatgactgggaacaagagattggcgttctcatcgatcctgatgaatacgctgaagtttgggttggcttggtcaatgaacaagacgaaatggatgatatttttgctaagtttttaatttcccacaaagaggaagaccgagaatatcacgttgtatggaaaaaataatctaagctcaaaattgaggaaaatttgcggttcaatagcctcttcgtataattgctgaacttccgattttgctatttaatataaatcctagaatattactattccaaataagaagagcggagaattccgctcttttagccttcaaatgcgttgtgattagttgaacatggcagaaatagattcttcattactaatacggcgaattgactctgccagcatacctgataatgttaatactcggactttgcccaatgccttaatttccggtgtaaatggaatagtatcagttacaacaatttcatctaatgcttcattcgctagattttttgccgctgctccggagaatacggcatgagttgcataagcaaatacacgttttgctccccgctcttttaatgcttccgccgctttgcataatgttccgcccgtatcaatcatatcatcaactaaaatacaatcacgtccagcgacatctccaataatgtgcatgacttgggccacattggcttttggacgacgtttgtcaataatcgccatatctgtatcattcagtaattttgcgatagcacgggcacgaacgacaccgccaatatccggagaaacaacgatcggattttccaaatctgttttctttaacatatcatgaataagcaccggtgaaccgaatacattatctaccggtacatcaaaaaatccttggatttgttcagcgtgcaaatcacaagttaacacacgatctactcctacgctcgataggaaatctgccaccacttttgcagtaattggtacacgggctgagcgtacacgacgatcttgacgagcatatccaaaataaggaataactgcggtaatacgacccgccgatgcacgtcttagtgcgtcaaccataacgactaattccatgagattatcatttgtaggtgcacaggtagattgaataataaatacatcacaaccacgtacattttcattaatttgaacttgaatttctccgtcactgaaacgaccaacagtcgcatcacctaaggaaatatataggcgttcggaaatttgttttgccagttcaggtgttgcattaccggcgaaaagtttaatgtcaggcatcgtaaatttaacctctggaatttgtattattaggaagacaaagtgtttgtttttgttgcgataaatattcaatcatttgatgtaatggtgaaatatttgttccctgagcaacaaaaccaacgtatttttcaggtttatcaagaaatgcagattgtgccgcctgttcgttagcaaattcagcgaaaacacaagctccagttcctgttaatcttgccggtgcatattgtaacaaccagccaagggcttcttcaacctctgaataatgatttaaaacaactttttcgcaatcgttttcatattttgttgttaataattccgctaaaggtcgttttggggtattgcgaggtaagttagaatctttaaatataatagctgtagaaatagatgtttcgggttttaatactaaaaaccatttttgtggcggttgacaaaaagtaagtttttcaccaacaccttcggcaaaagcggcttttccatatacaaaaacaggcacatcagcaccgagctgtaatcctatttcagcaagtgttgagagtgaaagttgtgtattccataaatagttgagtgcaacgagtgctgtggctgcatttgaggatcctccgccaacccctccgcctattggcaaaattttatctaaatgtaaatttgcccctaatgtacaccctgttttttgttgtaataatttagcggctcgatagattaaattatcctcgttttttagatgaggtatttcgggtgttaagattatttttccgtcagtgcgtatctcaatacttaaccaatcgccaaaatttaaaaattgaaataaggtttgcagttcatggtaaccatcggggcgttgagaagttatatataaaaacaaatttatctttgcagggcaaggaaaacgtaatttttttccttgtatttgcgatgataaaagtgcggtcgaaaattgatagtttttcattaatatttccagttatctatcctaacttttaaggtctgctcactacttttcagaagaatatctttgggtaatggaatgctttgatctgttcgatagttgagatagtcagcactccaaacttcaccctcaactgaataagtaaagcttgctaataaatgatttatgccgacctgataatctgaattttcatctggttgaccttttagccagttccctatttgttgtaatggaatagagataccgatcatttcacggagcaagttgttgatatcttttgttgaacgctgatttcctttatggtctgaaacagtaataccaaaaggtgaaacttcaaatttaagtattgaactgctgaaagctgatgaaagtagtaaagaataggattgcggattgttatattgccaagtaaagcgagtggaaaaacgttgtttattgttaatataacccaattgtccttgagcttgatattgttttatttgcttaattttttgtaggtgttgttgccattttttatcatttttttctatatactgaataccttgcgggcgttcgctggcaatatctaaagtacaagcgctcagcaatatcgttaaaataagtataaaaaaaggtttttgagatgttttcatgtgtcggactcgtaaaaatatcggatattttaaggtcttacataagattagtaaagatacaaaaacttttgattttttgaccgcactttgatctgtttattaaaagatgccaatttaaatttatttgaagggtagcttacttcaatttttacaatgatctctttttaaggaaacacaatgaaaaaatcatttatctcaattgtggcgttagacttattgggagcggtttgggttggtacttcttggtataccggtaaagtagcggaacaggaatacaagacacacttagaacaggttaaatcgaaattacccgtaaatccgaacccgatagctcatctacatgctaagatcaatgatttacaatttaatggtcgttcttttactgatgaagatattaaacatgtaataatgaacagcggaattggggataaattaggtttacagtagattgtaggttggctgatttttatactctgccaattttttctcaacaaaggggattatggagaaattttaaccttgaaactcattgccccaagcaacttgtttggaaataactttatacataatggtgattatagttgctatttttttgaagacgaacaataatagtgtaccgataagcaagaacaaatgatttttgcgaggatattttttgataaactacgatatggttatttttccgtatcgtagttttgttttacttaaaaaggaagtgtacaacaatgaaacaaattccaatgactgtacgtggtgcggaacaattaagagaagaattagattttttgaaaaatgtgcgtcgtccggaaattatcaaggcaatttcagaagcacgtgaacatggcgatttaaaagaaaatgcggaatatcatgcggcacgtgaacagcaaggcttttgcgaagggcgtattcaagaaattgaaggtaaattagcaaattgccaaattattgatgtaacaaaattacctaataatggtaaagtgatttttggtgcaacggtcgttttgttaaatattgataccgacgaagaagtcacttaccgaatcgttggagatgatgaggcggatattaaatcgggtttaatttctgttaattcgcctattgctcgcggtttaatcggcaaggacgttgatgatactgttgtcatcacaacacctggcggtaaagttgaatttgaaatcgttgaagtagaatataaataacataacactttgataggaaaaaaatgggcttaatgcccattttatttgtttcagttattggcgaggtaactgaattttgggttcattacttggacgataaagtacaagaacatgccctatagtttgtaccgcactggcttgcgtttcacgtataattgcctcaataatcagctgttttgtttcacgttcagcaccagaaattttcactttgatcaattcgtggtgatttaatgcgttgtcaatttcagctaaaaccccttctgttaaaccatttgtgcccagcataaccaccggatttaaatgatgtgctaaaccttttaaaaattgtttttgttttgttgataatgtcattggttacccatcctacataattaaaagtgcggtcaatttgataacaatatttcaattgcctttatctcgaagattttaaccataaatccaaaaaataaaaagaaggaataattattttatagaatagttaaaacactttccggcggtcgtcctattttagctttatctccatttactacgattggacgttcgagcaatgcggaattttgcgagagtgcaatcaaaagttgttgttccgttagctcctgactattcaatcctaattgtaaataaagatcgtctttcgtacgcatcatctcccttacagacgtaattcccaatttttgagctaacgtttgcaactcttcaacgctgtaagtttgctgtagatataattcaacgtcaaaaagaatggattgttgttccaataaagccaatgtttcacgactttttgaacaacgtggattatgataaattttaaccgtcataaatgctcctttgctcagatacagttcaaatatgcaaaattttaccttataatcacccaaaatgctcattcgttaaggataaattatgattgaaatgttaaaaaattggtatcatcgtcgctttaccgatccgcaggcgatggcacttttcgctattttattctttggatttgtggcaatttattttttcaatagtttattggctcccctcctgattgcgattgttttagcttatttacttgaatatcccgttcgcttattacatgaaaaactgaaactgcccagaattttggcgacatctcttatactcggtggctttatagcaatcacatttgtcatgacctttattttgatcccggtactctgggcacaaaccatcaaactggtcagcgacttaccacacatgttcaatcaacttaacgaatggttgctttctttaccggagaattatcctgaattagtagattatcaaatgatagatgcgttttttatttcatttaaaaataaaatattaggcttaggtgaatctgcacttaaactgtccattgcctccttgttaaatcttgttaccttaggaatttacgcttttcttgtgccattaatggtatttttcctcctcaaagataaaacggaattaattaactatattacaaactttctgccaaagaaccgcactcttgcctcaaaagtttggcgagaaatgcaacaacaaattgccaattatattcgcggtaaattacttgagattttaattatagctttagtcagttatgccatctttctattttttggtttgaattattcattgttgctggcagttgccgtgggattatctgttttagtgccatacattggtgcagttctggtcactattcctgttgctttagttgccatgttccaattcggtgcaaccccaactttttggtatttaatggttgcttatgtgataagccaaatccttgacggaaatttactcgtgccatttttattttctgaagcagtgaatttacaccctctcactattattatcgccgttcttatttttgggggattatggggtttctggggaattttctttgcaattccattggcaacactagtcaaagccgttgtttcatcttggccgtcaacagaataaccgataaggaagaatttcattgaaagggctatttattaggattgttttagccatctgtttatcgctttgggcaatagatatggttttcccttggcaacaaatagtgagatcaaaacagaattaccatactacaattcaagagcgacaaaaattgattgtaggaacaatcaataatccggtgtcttattttatcggtacaaacggagaaacagggctagaatatgaattaagcaaggcttttgcaaattacttaaatgttgatttagaaatgtttcctctaaatagtgcggacgcattatttcaggctttagcacaaggtaaaatagacattgccgctgcaagtttattttatcaacaagatagaagtgaaaaattcaaactaggtccggcatatcacgctgcatcttggcaattgacttatcgcaaaggtgaacgtcgtcctatcacattagaaaatttatccggcaaattggttattccggctaattcggcactgaataatattctgctggcaaaaaaagaaaaatacccttctttaacatgggaaaccagtgaactaagccaagaggaactcttatttcaagttgctgaaggaaaaatagattacacaatcgctacctctactgaagtatcagttaatcagcaaattaaacctcaaattgcaattgcctttaatgtgactgatgagtttacagtacattggtacttatctgataagggggcttcagaattacaagccgcactattagacttcatgaactctgccattgaaaacggcttaattgctcgtattgaagaaaaatatttcaatcacctcaaccaatttgactatgttgatactcgctcctatttgaatgcaattgaaacagttttgcctaaatatgctcctttgtttgaaaaatataaaggtgatttagattggcgtttattggcagccatatcttatcaagaatcccattggaatccggaagcaacctcaccaaccggagtacgcggtatgatgatgttgacaaaagcaactgcagatagaatgaatattactaatcgtctcgatcctgaacaaagcattaaagccggttccgaatatttacatcttctgctcaaacaaatgccggatactattttaaaagaagatcgtatttggtttgcacttgccgcttataacatgggattgggacatttattagatgttagacgcttaaccaaacagctgggaggaaatccggataattggttagaggtgaaaaaaaatttacccttattagcacaaaaacgttattttacccatcttaaatatggctacgctcgaggctacgaagcgtttcaatatgtggaaaatattagaagatatatgaacagcataatgaattattatcggcttcaacaaaaccaacaagatcggtatgaaaatgaaaataatgatgtcatttcaatacaaacacaacaggaacaacgatgagaagaaaaacctttttaaaaaaaagtaaagtcacgctatatcgtaccgcacataaccgagcattaagaattaaacgcttaaaaaaacgtaaagcccaacaagcagcacgacatgcccagcaattcgtcatacaagaaatttgttgctgatttttcgtgctgtaaaatcatattctttagcatatggatataagaccaatcagataaaaaagcggaatttccaccgccctttttgctttacataacacaccctaccaaaaccggatcgttaaattctgttttacagcaacccttaattaacaaaacattcaaggcaagcgaaaagaaaaaagaaaaagaaaaagaaaaagaaaaagagaaaagcgaaataaaaaatgattgccttattaataaattttgtaataaaatctccgaaatttattactatccgcttgacaaacaaaaataacatgaatttacagcctacagcctacagcctaggctaacgccttgttgcaaatcttgcaaaataaattttaaaaagtttttaacctctaaaaatatcccagttttcccttttcaacctctcggcgaaaatatcattcgtctttttttgctttgccttaaaaagcaaagcatcgccgatttatacctcattaatctacctaaaaaacaaaaagtttaatccattcacaaccataaaaaagtgaaaaaaaatcaacaaaataaattattaaataacccattttaaaagattaaagagagtaaaccatgaacaaaatcttcaaaaccaaatacgatgtaacaacaggtcaatgtaaagccgtgtccgagttggcgagcaatcgccaaatagcgagtagctcggagaaaaagccaaagtgcagtgctaatttgaaaagaacgagcttgtcagaaaacttactgttcaacatgctgatcagcggtttggtgttgtttgcgtatcccgcttgggcaacagcagctcaagctcaaactaacaaagaaggagatatcaaaatagatgctgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggtcaacgggtagtgcttggtaataaagcctacgccataggcaatcaggcggtggggataggtggtgacgtattcgcccaaggctattcctctatcgccatcgggagcgatgatatcggcgaaacggctgaggagaacccaaaaaatggaagtggaaatgacaaatactccaaatacgccgtccccctacctaaagccatctggcagttgtttattgatgagggagataattttaattcaaaaacgaaaaataactatgctattttacaaaatggtaatagtgacggtagcaacggcaaagccaaaaatatttcagagtttaatagcaatgggaatggtaaaccaaaaatcgacagaaataaacaacctgatgaatgggaaaaagcatatgcagaatttaataaagacgcatatgaaaaatacgtagaaggcacccaaaacggcggtagcagtcaacccaaaaacgtctactcccacacatgggcaaaagggcgtggggcgattgctatcggagcaagatcaatcgcctacggcgaccattctaacgccataggaacgcttgccatcgcaaaaggaaactactcgtccgcctttggtacgggaaccatcgcttttgaagaaggaggtattgcagtcggaaacagtgcgtatgtttatcgagaaaattctatcggcgtgggaaataacgtccaagcaatacaaaaaggctcgatggtcttcggggtcaattcctatgctggcggtagcggttctttggcattaggggaatatacctttgcgaatgtcaccatgcatgatgagtttaatgggaaaacggaagctaagaaagtaacagaatttacaaaaataatggaggattataaaaataaatataatgcagagaatcctgacaaatcaccgttaacatttgctagttatacgcctgattcaccagaggaaaaaataaatatagaagacctttatactgtgccagcctatgatactaaaacgatacagcatgttggaaaacaattttacaaagccaaaacaactaaacaactaggtacaggcgaagaaaaagccgaacaatccaaagacagcaaaggcacttataaccaaggcggtatagccattgggtcgtattccgtcgcattgggggataacgcccttaccctcggtagacacgcctacgccaaagaagacagcacggttgccatcgggaacttcgcctttgcaaaagatgaaaacgccttcgccctcggcaaagccgcccgatctatgggtaaagattccttggcaatcggggtggaagcggaaatttggagtccagatgccgtggcaatcggcacaagatctaaagtggaacaaaacgccgmkggcggtgtcgccattggacaaagtgcgryrgtkgmarysrrygcyggygattctattgcgwtkggtaaarrttctaaggcgrragmgaagaaacaagcctttaaaacccaagaagttaatgtgggtacaaaaggcttgatgtttgactggggcagtgcaggcacctcagaaaatgatcaagaggacaagaaaaaagccgtggtcagcgtgggaaatattggtagcgagcggattatcaccaacgttgccgctggttctgttatgaacggttccactgatgcgattaacggcggacagttgtatagtgtgattgaaacattcggcaaactcggcacggatattcttggtgcgaaagtatatgataaggataaggataagagtaagtacggatttaaggcttcaacgtttgaaaaagtaaaatatcatcgagaacagccacagggacarggacaaccacaaccaactgccccaaaaacttttaaacaagccattgatgaaaccattaaagctgtaaattccggaatgaagttcaaagccggtaatgataatggcggtagcaataatcctatcaccaaacaacttggcgacacgttaacattcaaaggagacgacaagtatatcaaggcgactgtagaggatgatgctattaaatacagcgtagaagtggcaaataacatagatgacagttcaaccccacctagtccaggtggagcaggagcaggaacaacagatccaaatgataaattagtaacagcaagtgcggtgaaaagttatgtcacgacaaaatttggtgcattaagttcaacgttgaatttagaaaccgatcaaccaactgatgacagtcaaaataaaggaaaagttgacttaaaaacaggtacattaaaaattactggggatgcaaatatccaaacctcaatagatactaatggtgaaaaaaaattaagtataaaacttagtgaaaatttaactaacatttcttccataggtaaaggtagtaatggtaccaaaatcacatttgatgatagcaaaaaggaaatcaaacttggatctgtatccgtaagtgtaaatgatcagcataaaatcgtaatcggtgaaggttccaaatcagaatcaaaccatacacttgcaatagggaataaagccataataggtcaaaatgcaaaaggctctatctctatagccagtctaacaaatggtgagcaggggaatatacaaaacgccgaatgggcaatctccatcggtaataaaaacaacgtttcaggcggaaatgatattgtcgctttggggtcgaatattactatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatgggcggttgctattggtaataacaccaaagtatctggcggaaacgacatactagcattgggttctaatatttcaataactggaagtaataatggaagtgtagtcgtactaggtaatggtgcaaaagctagtgccgcagaaaacagtgtggttataggtaaaggagcagaatcaaaagcccaaagtgcggtggttattggggaaggtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgatgtacttggtgcagagaaagaaacggaaaaagagaaagatggaaaaacagtaaaagacggctttaagaaatcagaatttactnnnnnnnnnnnnnnnnnnnnnnnnnnnnnnnnnnnnnnnnnnnnnnnnnnnnnnnnnnnnnnnnnnnnnnnnnnnnnnnnnnnnagagaagcgattaatgaaagcattacggctattaacaagggcttgatgttcagagcggatatgccaagtgcggtaacaaatggcactcaaaacacaccgcactatcttggttcgaccattcagattgtgcgtttggcnnnnnnnnnnnnnnnnnnnnnnnnnnnnnnnnnnnnnnnnnnnnnnnnnnnnnnnnnnnnnnnnnnnnnnnnnnnnaatttaatcacgcaatatagcaataccgatggcaacgccaaaatcgaaatcggttttaaaaacgcaccgacatttagcaaagtaatgcttgatgaagaacaaacatataatggcgtaaatggaaatagcggaagtacagattggaaaaaagaactcatcactaaaggctaccttgaacaagcgttagataagtttaagtttaaagtatctactggcgagggtgatggtaaaacttwtsaaatcggtcgtggcgatacgttgaaatttacgagtgatcagaatattaaattgactttagagaagaaaaatggggcaacgtctgctagtagtgcaacagctccaaccgctgcaccagcaccaacgcctgcaccagcagtggcaagcagttcgtcaagcgatgtaagtacaaacggcggtggttcaaatagtatggcttcgtcaggtggttcaaatggnnnnnnnnnnnnnnnnnnnnnnnnnnnnnnnnnnnnnnnnnnnnnnnnnnnnnnnnnnnnnnnnnnnnnnnnnnnnnnnncaccaaccaccactacaccaacaacggctgtggtaaccattggcacgactagcgatttgaaaaatataaaatcaatttcctcaccgtctaaaggagcgaatgcaggtacaggcggaagcggaagtgcgggcggaaattcaggtgccagttcaaatggagaagtcactaaacttacgttagaagcggagaaaggtgcgacattccaagtcggtagcactggtgcgaaagtgaatatcaataaagagggtatttcacttacaccacaaggggcgaatagnnnnnnnggatcaagtggagcagatccatctgactcaccatcaatcactattaaagcaggtgcaaaaccagtggatccaaaaagtttagannnnnnnnnnnnnnnnnnnnnnnnnnnnnnnnnnnnnnnnnnnnnnnnnnnnnnnnnnnnnnnnnnnnnnggctcaggcaaaatcaccggtcttgctgatattaagtcagatgaaaaagacggcaccagtgcaactaataaaaactatgtcgatggcaaagtatccgacttaaacaataaccgtccatttgatttttatttagacaaggaaaaagtcgtgaaagataaagatggaaatttccacaaagaaaaagaacctagcaaaaatcttactgaggaagagaagaagcaggtcgtgatcaaagccgaaccaagcaccgcacctattgggattagcaatgtggcgagtggtctaggactaccagcccctgaaaaagatgaggaagaaaagaaaaaggcacagcaaaaaaacactgaactcaccaaagctgttgaggaaaaagtgaaagcaataggcgaaaaagctaccgcactttcaactacagctcaaaaagtaaccgatttaactttagcagtcagcggtttggaaatggcgatgaatgcaatgtctgagggcgaggataaaaagaaacttcaaactcaattggaggaaaacaagaaacagcttgaaaaagctaaagaagagctagggaaagcaaaaactgctttaaccaaagctcagacagaattaacaaaagccaatgctgactatgaagccaactacaagggttatgaaaaagttgctgacttagtnnnnnnnnnnnnnnnnnnngaattaaccaacgcagcaacaatcggtgatttgcaggcggtagcgaaatcgggcttgaaatttaaaggcaatgatgacatggaaattcacacagcattaagcggtacttttgcgattaaaggtgaagaaggtgcgaatggcaataaatttaacagcgaccgcactgctgccggtaatatcaaagtggaaatgtctcaagatggcaaagggctkgaagtcaaactgtccgatcagttgaaaaatatgacctcttttgagacacgtgaagtggasggkagaaaatctacgctaaacagcaatggtttgatagtggtcaataaaggtgcagataacaaagtcaaatcagcaacatacggtgcggaagcgrtggtgttgtcgaatcaagaaaacggcaataaagccgtggtgaccgctggcggtgtccattttgccactacccaagccccagcgacaggggctcgtgcggggacaggcgtgattacaggcttaaaagacctagacgcacgctcgacaggcgacatggcaaccaacaaaaactacgtggacgaaaaagttggttccgccgtcaatcgcttggataatgcgatcagtaccactaacagacgcttgcaggcgggtatcgctggagcattggctacaggaggattgccgataacggtgatgccaggtaaatctatgttggcagcgtcggctggctcgtataaggggcaaagtgcagtggcattaggctattctcgcatgagtgataacggcaagataatgctacgcctacaaggtacaagcacttcaacgggcgatgtcggcggttcggttggtgtaggctatcaatggtagggttctaaacgccagmaaaaytcaccgcacttattgataagtgcggtgggtttggtagggatgattagttaaatctcaccaaaacagtgaacaatgcactgtcccaaatattaaactaatttattctcttatgtctcaggcttaagatctaattttgccatgagcaattgatcgccatcttcttcaggattgactgttaccaataatttgtcaccgtaaaaaatagaatttgctcctgccataaaacacattgcctgcatttcttcagacattccttgacgaccggcagataaacgcacatagcttttcggcatggtaattcgagcaacggcaattgtccgcacaaattcagtccaatctaattcttgagcctcggcaagcggcgttccctccacttttaccagctgatttattggtacggattcaggctgaggatctaaatttgccagacttgcaattaaacccgcccgctctttgcgagtttcattcataccgacaataccaccacaacatacttttaaacctgctttcctgactttaccaagagtatttaatcgatcatcaaaatctcttgtgccgataatttctttataatgttcaggtgcggtatcaatgttgtgattatagtaatccaatcctgcctcttttaattcttccgccataccgtcttgtaataaaccgaaagtgccacaagtttccaaccccagatcttttaccgctttgataatttcagtaatttttccaatatctttcggcttcggtccacgccaagccgctcccatacaaaaacgccccgcaccacgagatttagctattttcgctttttcgacaatttcctccacacataataattgctgattttgtacgccggtatgataacgtgcagattgtggacaataaccacaatcctcagggcatccgcctgttttaatagacatcaatgtcgaaagctggatcgtttgtggattaaagtgctttcgatgtacctgagccgcttgatacacaagttctaaaaacggtgtttcaaataacgcctcaactttgcatacagaccaatattcaacgcaaggatgcagcgttaaagagggaatgttgatagttgtgattgtcatattcttttccttatataaagtgcggtcaatttcaacgaggaatttccctctctgttgcttgaccattttttatttcaactatgcgatcaattttatctatcacttcgctcagttgatgagtaaccaataataacgttaattgtttttctctacagaacttatcaatcaatgtcaacatttcctgacgtaaatgaggatctaacgctgaaaaaggttcatcaagtaataaaatcggtttatctcgtaacaaacatctcgctagagcaactctctgtcgttgccctcccgacaattctttaggtaaacgtgataaaaaatccgttaaacctaccgcacttgctactttttccagttgtttgatttcttctttgctcaacttcaaatccgctcttaaaccgatagcaatattttgccataccgttaaatgagtaaataaattatgctcttgaaacaaaatggaaacagggcgttgatgtggtgcggtataagtatgattttcaccatttagccggatttccccttgcttaaccggctcaaatcctgcaattaagtttagcaatgtactttttcccgctccgctttcaccaataatagcaatcttttcgcctagacttatatgtaaatcaaagtgcagagaaatattgggataatcaaaaatagtgtttaatttaatcatctttttttattcgttcaattaatataaaaatacatgtacaaaaaacgagtaacagcaatgcagttactgcaccttcgtcagagcgataactacctaattgttgatataacaaataaggcaaggaactaaaatcctgattcccgaataaagctatggcagtaaaatcccctaaggaaatagcacaagccagtgcaaaagcatatttaaatgatgcttttaaattatgccattcaattaaataaaatctattccaaccttgaatagccaaggattgcgatagtttttcgtaatgttgcatattgttgtacatcggtaactttagaacctgtaaaacaaaaggcatggcggttaagccattacatagtacgactaaagcaaataaatgatagtgggagaaatccatttcccttaagcgaataaataaacctactgaaataaccaagacaggaacagccagcaccagcattccgctatttaaaatactctgagataaaaatgaataagacaaatagtgtaaacggcgtgccagtaataataatgaaacggaaaataacatcgctaaaatcgctgataaaggtgcaatagctaacgaataacctaaagcctgccaaagttgtgattgctgccaaatttgccataaactttgtgcttgaaaagcggagaaaacaatatttattaaaggcaagctgatgaacaataaaacgcaattgatataaaaaatttgccagatttgtaccgctcttgactgcttttctaaccaaatatttttactatgcaataacacttgtggcgatttttgccataggctacccaatgcaaacagcacacaacaaaaaattacttgtaacaacgcaaataaagccgacttcgccaaatcaaattcaaataaaacggcttggtaaatagccacttccaatgtagtgtatttaggaccgccgcctaaggtgagaacaatagaaaaactggtgaaacacagcataaaaatcaagccaaaaaccggtaataattgttggcgtaaatagggaaattcaatcaaacgaataaactgccaaccacgaagattcaattgtgatgccagttgcctttgctgagtgggaattgtttggaatgtttgcaaaaacattcttgctgctaaaggaatattaaaaaataaatgtgcaattaaaataccgcttaaaccataaatatggggttgccacgttatgcctaaaaaggttgttaatttaaccagccagccgttatgtccataaactcctgtgataccaaaaattacaactaatgcaggcaacacaaaagttaacgaaaatagcttaagaatcaaaggttttgctataaacctttgatagaaaaaggctcgagcgaataataagcccaaaaaaacggaaagtaaagaagataaggtagcctgtccaaaactaaataaaataacttgcttgatgtaatcatctcgtatcagttccgtccatttataatcagtttcaacagtaaaaataccgctcaatactagaccataaaatgaaacaataaataaccacactaccaatccacttaatgagctgattggtaatgtggaaaaataacgccatgcttttaacaaattacttcaccaaacttgcttgccattgattaatccatttttttagttgctcagcagaaatattggaactgtcaaacacatttgttttgagctgatactgttttaaggcatcataatgtggctcaatagggtcagaaatcacagataacatcacgttatttttaacgatatgtgtctgtgcttgcggtgaaatcaagtaatccataaataaatcaccacaggcattttctttgtttgctattttggctgctaattcaacttgtaaaacgccgccttcagcaaaatctgtcgcttggtactgatctttttgttcatttaataaatgataaagtggagaggtgctataacttaatactaaatccgcttcaccttttaaaaatgccccataactttccgtccaacctttaccgacagtaacggtatgtttagctaatgtctgccaagctcgatctacctcttgttgtggatacaccaaatttaaccaaatgattaatccccgccccacactgcttgttcgaggatcctgataaataactcgtaaatcctgacgttcaaccagctcttgcaaagattgcggtggatttactaatttagttttatcataaataaaagcataatgcccgaaatcataaggtaaaaaacgtcgatcttgccaagaaatcggtaaagaaagtctatttaaatcaactttatgctcactaaataattcagacttgattgcctcttgtaataaatgattacttaagcctagtacaatatccgctttggttttcttaccttctaaacgcagacgattgaacaatacacctgaactgtcaaaggacacataatttacccgacattgcggatattgttgctcaaatccttgtttcacctttggacctgctccccaatcggaggaaaaacttttataagtataaacggttaagccttgtgccgatttcgcttccgcttgagcaaaagagcaaatagacatcgcagaaagtgcggtaaaaattagagtggttttgaagttcattacttttctcctgtttgaataaacacagcatgataagtaatattgacttgattggaaaaagaaaggagtaagaccattagtttcctacgtcagtattaactgtatcaggttcacgggtattatctcagctgttatcagcaccccgactaagtcggacaatagtctattatatttttgttgaaaataacaaggaattttctcttaatctttgacttaacttcaagaacttattatgtctaatgtaatgtacaatttttttatcaaacattttccggcacaatacaacgctacactttttcaagaaattcaaaaaaataaacataatcaaaaaactcaacttgagcaagttatggattatgtttatcagatttgtcgttttgcttgctcatatacaaaaaccgaacaccatcctcttattaaaagtaaaattagaattttaagcaaaacaaaaacgttcccaattagtaggcaggaagagtttcaagcctgtctaaaaagaaacgttttgaagttatgtcagattaaaagaaattatttaatcaattattttttttgtagttgaccacattaaagaaacgtcttccttcttgctttccggcatagccacttttttgccaaaaggcattcttcaaccaattctcaaactgctgatgagttggaaatgtcatttcaccaaaattcggatcaaagaaaataacttttgagccgtcaaccgccgcagatacagtgtgagatcctccctcaagattaatggagattttcttaacaccggcagtatcatcgcctgtatccaaaatcgcttttactaatgaggatacatcattttttgatacagttcctgatacttcatcacgacgaacaaaatccgctacttttttctctttcggaacaacaccttgctcttgcaaccaactatctgtcaatttgaattgttgagtcgcactaccgctattaataaactcagtttgaagttttttaatagaatcaatagtttcttttttcaagtgtccttttttaccaccttcataaagggtattaaagaaattctcgtcggttggattaacattttttgcaatccaatgtgcacaagttgattcacacacaccattttgtgtttcaatgtgttttacaatttccttgtaaacttctcctttagattgggcaaacttaaagcttacttctccaccaaactcttcaacggaagaacgtacagcatcaattttgcttttcactttcaaaggctgaaattgatcctgaatgcgttgcaataccgtgcgttgctgttccactaaatctttactgctcaccaaatcactaactggtttcgcttttgcctgttccgtttcagtcactgtttcagaaactgtcgcagatctaactgttccggaactcaaagcagccgcattttctaccgcactttctgtcaaatccgtagaagtgcggtcagttttttctaaattctgcccgttatcttcctcgcttcctttttttgccaactcttttaaaaactcaactaccacttcactgctcgttgcggatttagttgatgctttcgtttgaggaataatctgcggttcaaactcatcactaaatttggtaaatgccggataacctgcgtcaagtaaaattttatttactatgactctcgccatacgtccattaccttctgcaaatgggtgataagcaatcaatcgctgataaactaatgcccctaccacgctcggctcaattccttcacttttcgctcgattgataaaatcaaccgtttccgctaattgaatttttgccgcttcgggactagaaaataccgcattttctttggttaaattctcttttttataaagtaaacgaccttctccctcatccggacgtaatccgtgattaagattctcgatcatctgcactgtcaaaggtttgccttgactgttttgtaagaaatcctctattgctgtcttcaactgttctttcaactccggtgtacgttgaatggttttcgacgtcgcagctaaagcttctgtgatttcatttgtttttgttgaaagatcctctataacctttgttttcggtaacgttttcaccaaatcttgaatttctgaaaactcctcaacagaagggcggaatgtgattgccttattaatacgactttctactttcttagctccctcggtaagaatatcatcaaattcaggtaaatgagacatttgcttaactgtcgcttcaggaattgatttcttcgaaatctctcttgcttcatctaaaaatttctcatttttcaatacattactttcaaaattagcatttcgatcatcttctaaagaaattaatccttttaagttcaaattatcttccaaatcttgataattgactttattcgctgtctcatctcccgctacaggcttcgcaccgcccttacttccggtgaaaaattgtttcactcgttggaaaagtgtggttttttctttttctacacctgtagccccctctgatttctctgctacttttttatttcctccagcagcatcttttagttctgctggtacagatgacaacggtgcaacttcatttacagaagtctccactttcggaacagatggtaactgaccacctgctttaccttgttccggctgtttaatggtcaaactgtctgcggattgtgtgttttcgacttcactaacatctttagacttcaacgtaacaggcgaagtcgcttgtccgttttgattattcgcacctccctcttgcggagatgattttttacctaattcagtcaaaaactctttcacaacttccgcacttgttgctgatttagccgtagcttttgtttgcggaatgatctgcgtttcaaattcagaactgaatttagtaaacggcggataacctgcatcaagtaaaattttatttactacaactcgagccattcgaccattcccttctgcgaacggatggtacgcaattaatcgctgataaaccaaccccgctaaaacacttggttccacattttgcttgattgcttggttaataaagtccactgtttcatttaactgaatttttgatgcttgcggactggaaaataccgcattttctttagttaaattttcctttttgtaaagcaaacgatcgctaccttcatcaggacgtaatccatgatttaacttttcgatcatctctacagttaactctttgccctgactacttttcaaaaattcttcaatcgcaccttgaacttcttctttcaattttggattacgttgaattgtttttgacgtatctgctaaagcttctgtaatcgctaaagtttgtgcattgagatcatctaccgcacttcctttttgtatatttttcaccaatccctgaatttcattaaattcatcaacagacggcttgaaagttaaggcatcattgatacgtttctctactttcttcgctccctctgttaatatttcatcaaactccggagaattacccatttgtttgattgtagcttcagggatgtatttcttagcaatctctcttgcttctgccaaaaattcaggatttttcaatacattttcttcaaaagaagaaccacgtttatcttctaaagccaataaatttttcagatttaagtcatcttccaaactatcataatttggtttagaagcagtttcctgttcagattttgtttctttagcctgtgatttactcgatttcgcaaagaagaaatcttttactttcgcaaaccaagatttctcatctgattttgcttttggcgatacgccctctgctccttctgattggagtttctgattaccgttattgttgcgattactttcagccaacgcacttcttggtgtacctaatacagctgattgtccattttccgcaactgtttcattgcttattgaatcgctcaaatttgatgggcgtggcggtaattcaggtgccacatcatcttccactctcgcttttacaatcggatttgccgctgccgcttcatcaccttttgctttcgctctcgcaagcccttccggacttttatccaatgttgcataaatcggctcgtttacctctggttttgccgtatttgctcgatcttctttagattttaaccgagcttttaattcattaaccagttcatttacaaccgcattttccgccggtaatgcacgtttcggcgtttgtggctcggaagacaattccgatggaatcggttcaaattcttcaccgttcgactgaccacgtgccgatctcggctgtattgatggagaggtaatttcagcataatctccctctactgccgaacgttctgtacgcaccgctgtttgcgatggttcgtctaacggaattgtctcataatcactaacttgaccttttgcagatctcggttgtaacacctcagcaattgtcgcataaccatcttcaccctctgccgatgtgcgttttacaggtgctgtttcttgtggtgctgtttcttgtggtagtggaatttcctcataatcgctacttccctgctgacgagatgctctcggttgtaacggcgaaacctcaccaattgtagcgtaatctccaccatctaccgcaactttaggcgtagcctccggtattgccggtaaatcacgttttgctttattcgctctatttacaacatcattaatgtcggcataaatatgatctgccgtatcaacttcctgagttaaacggaaatttggaagtgccggcagaggatcattcgcactgcgagttttagaggtaatttccgaataaatttcattacctacttcttccactttgcttaacaagcttctcactgtcggtaattccggcaattgatcactcgcagatcttctcacactgccgtacagcggattatccaccatttcaatgttagaagatgcttttggtttggacaatacgctgtaaatacttccaatcgtatcataaacatgatctgccaaatccgccccctgacttaaacgagttctaaactcatttggaagaggtggtaacggatcattcgcattgcgggttctagaagtaatttccgaataagtgccattacctgcttccgtgtcgctattcaacaagtttctcactgtcggtaattccggcaattgatcactcgcagatcttctcacactgtcgtacagcggattatccaccatttcaaggttagaagatgcctgcggtcgggacaaggtactgtaaatgctctcaatagtatctgctagaactttatttctcgtcccttcaccacctaaaaggctgtaaggactatcactttcaccacctaaggttctatttctaaccgcacttccattacctaaaagactgtaaggaccttcaccgatttgttcgtaaatatgttcctctgcggcttttggttttcctaaaagactataaggacctgctgcaatttcatcataaacatttgatctgatacgagaaatatctgaatttgcatcacctaccgtactgtaagtgctatcactttcaccgcctaaagttctatttctaaccgcacttccattacctaaaaggctgtaaggaccttcaccgatttgttcgtaaatatgttcctctgcggcttttggttttcctaaaagactataaggacctgctacaatctcatcataaacatttgatctgatacgagaaatatctgaatttgcatcacctaccgtactgtaagtgctattactttcaccacctaaggttctatttctaaccgcacttccattacctaaaagactgtaaggaccttcaccgatttgctcgtaaatatgttcctctgctgcttttgttcttcctaaaagactataaggacctgccgcaatctcatcataaacatttgatctgatacgagaaatatctgaatttgcatcacctactgtgctgtaaagatcatcgctattgttacgtaaggttctacctttgttagcgttgctatcgcctaaaaaatcgtaagcaccttcagcactcactttgtcataaacaagctcatctcctaatgctttcacttttcctaagagactgtaaatatcatcgctaccattaggcaattttcttcctttattggcattttgatcacccaaagtgctataaccttcactkgcctcatcagaagttcttagtttgcgtacatcagcactagaaccgtaaagcggattatctaccatttctgcaacatcttccgaagaaactctagttgtagtcggcaattcggcagcattatttcctgctttgctaaacttagattgtaatttagattttgctttttcacccaactctactaagtccgccacttcaaaattgaattgtgtacttgcatatacatcatctctcgtcacagtcttcgctttacttagatcatcaacaatttcgcccgttacattattatctttaagattgattccggaaataaccgatttttgtaccgcatcgtaatgtttttgctccgcacgtccaccacgagcattaaatgaagaagcaccacgctcgttaatacctacagaaacgccgacagaaccaccatctttatgatggctatcattgagttgttggctcgtaacatttcctgaaacacggaagccactattttcatctttattgatgaaatgagccgctacaagatccaaatctttaatttgtccggtaattctgttcgcaacaatacctgcctgctgattaagaagttttctgttctcaacttcatgagtataacctgccccaaaacttccattaccttttacaagtgtggaactagaaagtgcggcacctgctgaagcactaaaatcaaaacctctataaagtctatcgaaggaatcttgttttgatacaatgttcgttttacctttgatatttaaatccaaatgatccgctttaatatttgagctaatcaaattaagatctttacctgctgcaatttttagatttttcgctctcagcaagctgttgttatgtgtaactgatttttctgtcgagaaactttcattgccatcaacagaacccgatacgccaccattacaacctccgctcatcacgctacaacctgaatttataccaaatgcaaatttctgacgagattgtctttcagtactttctcttgttgtttcgccatcaagtatatcaacattacgtttggcttgaagagtcagcttgctgttagcatcgctttctacatttttcaactgtagatttccaccatgggctgaaagcgtaatattacctgcaatttttgtgcgaatgtcagaggtttccttaaccttatttgtttcgtaattacgctcaaatccaaacttagatgaaccgccgaccaattcgccggtaacaatatttgcaacatcgctaatgtgttgcaacgcaactgtaccatcttgcttaacgcctcgttgtgcctctacaatttctttcgctacatgactaacagcatctgcaatagctgagtgcccttctgtttcaataccgaatttcaagactgaacgttcagaatcaagatgatattcatctttttgtttattcgatgtaatctcttttgcagaaagttcaaagccttcatcttctttaactttcttatatttgttgaataaatcattggcagatttttctgtcatcaaatcatcaacttcactttgagatagaactttaaatttaggttcctctttctgagctgcgttgtctgttgcatcaggtgcggcttttgccttagcctgttgctcagctttcgcttcatcttcctcgactgcttttcctgtgaacttatgcttgttaatatcaacaccaccgatttccgcttttttcaatacatgtaaaataccatgatcgacctgcaaatcgctgttggtgtgagttaatgatgtttctttttctctcgtttcgctgaaagaaccgcccaaagtaaaaccagtgccagtattagacgatgcaccaccaatatttgttttctctccattttggctatcacgttcatggcttacagtgaaccctgcaccgctaatatgaccggatgaatattcttgatccaagcgaatgtaacgttccgtctgttgtgcattgcgacctgccttggtgttataatcaccttgtacaactccagtaacaacttttgccttgatcttactgccttcctgattcacatcattttttatagcgaaatgtacgtgatcaaattcggtatttgacccaacggaaattgctttttgcgtgctttccttacgatagcccaatatctcgcctttcttagagaaaattctacccttttcaacggaatgctcagttctgtgagtatctgtcgtattaaaattacgagctttcacaaaacctgttttacctttaatatccgatccttttgaattaatatctgaatcttcatctgcttcaaggtgtaaatgtccctctgttctaattgatgcacgttgaacttcaacatcgccgtttccattcacaaaagagcgggcagtattatcaattcctttatgtccaactaagcgagtgctttcctcacttaaaatatcgcctctatttttgattttattttcggcttcaatatcaatatttttgccggaaatcgtaccgctgtttagtacatctcttgttttcacattaatttcattagcacgaataagtgcatcaccaagccctttgaatttttcagcatctcttaatgttttattcgcaaaataaacttgtggtaacagaacctctttattgttgatatttgctttaacataccaaacaatgtcttgtttaagttgattttgttgttcttttgtcagtgcttctccaacttttaaacccaattctttagattcaaaataagagttatctattaattttttaaccaactgtgcatcatttacttgatatttcaatgccaaatggttatctactttcttctcaatagattttgtaattaactgatgttctaaatagttatcaccaattaccgccactttcttaccggcatcggtagatgaacctactttatttaagaaatatttagatccaaaatattcatcttggttaatatattgcaatttcgttctgtaaagcggatcggtttccactttaggacgtgtatcatctacctcttttaagaattggtttttcgaaagtgcttcttcaatttgatgatctttcgccagctcttttctgtattcttcaagacgtttttcttcttcaactttcgcttgtgcatctgcttgtttttgctcttcttgtttttgcttctctaaagcgatttgttgtttttcctcatcaattttgccttgtaatttcttctcttccgcaagtttttcggtttcttgctgagcaatttgttgcaactctgcttgtttttcaagtgcacttttctcttggcgttcttcctcttttttgtaacctgtttctagttcactttgtactttttcattttttgtttttgcatcaagagcttcagcttggcgtttctgctgtgctttctctttatattcattgaatttttgacgtaacttttcctgtacatgatcaggtaaagtatcaaaacgatctcttgtttctagccttgactcagttttataatccggttcgtctggttcatcgggttcgcgttcccaatcatcagacacctctcgaatatatgttttttcaccaatttcatccaataacttatctaagaattttccattctctgataattcgttttcattcaataaatcaggttcttctcctgtgtgaggttttaatagaaattcatcttcctcatcaatctcaatatttttatcgaccgttttatctaactgtacgctgttatccacaaaaagatttggaatagataacaaatctgacaatgcggataaatcaacattgctattattcagattttcttttccattcacttccgatctaaactctactttacttaagtcgaatttatgttgtcctacagtgatttgttcattttcagaaaatcctccggttgaaccattttctaaagcatctacatttcccttaattctttgagcaagaattttagctttatcagttgggcgataatcaaagtgggcatcttgtttttctttaaatgatttccaacgttctgacaatgttttatggttatcatttcgccaatccgccccaaaaacttgcaccatagccttttggaaagtatccgatttaatgtcttttaataagtgcatagcttgcgagttatccgcataataagaactggaatttgttattggttgctcagaaaataaaccgtcaaaaagctcctcaagagaattgaattttctctctgcttgccctgaaagtgcggataaaaagagacgggctctcggctgataattaaatgtaatatcttgtttttgtttgaaaaattcagtcaacaaattggcttggtaagccttcatattatttacaactttcgcattttgggcttcgaaagtgtttttaacattaatcacaccatgattagtgagtattgcctcttgttgattatctcctttcttaccttcgaatttgaaattcccttccgcacggatcaaacctgctttttcgactttcacctctgcttctttaaattctaccggattaatccataaacgatagtcgttattatgccaaccatgacttgcaatatcagaacggcgataacgggttaatacggaagaatttgttcctttactgattttgcccgatagttgaacatcattaattagttcattagcttttacagtaaggtcgttcttagcgaaaatattacccaagttgtaaacagtattttctgcatcaagatctatcttactctcagaatgcaatagagaatccgctccattaataatatttccttcagtttctttattatttcctttagcagataaagtcagttgttcacgagcacctaaaatccctttttcattatagatactaccttgtttagcattaatcgtcagcgtttttccgctggctaataatccgttgttaacaacattgcctttagcttcaatggtaagttttgcagtagtttgtagttcatcattttcgctaataaccacatttttagcatcaatagtcaactcatctttcgcttttataaaatggttacctttgctgacaaaacttgtaccatctttaaaagttaatttagctttagatttactttcaatggtaccggtattttcaaaaccaacatctaaatcagcaacggtttcttctttaacgtccgccttgcgtttattgtctttattgacagaaacagtgactttcttacctttggttttaatatccaaatcattttctgcgtaaatctcttttttattgactaatttatcggtatcaattgttactttatttccgtaaatacgcccttggttagtcaatgtttgagatttaagctcaagatccgttgcaacgacttttgtctcgtcatccaacacaagcgatttagttacctctacttttacttttttagaggctaactttcctttaccttttaacttagcttcctctgtggctgatgcctctttattattttttaacttaacatcatctgcggttattgtgatagacttatccgccgtaatctcatttgcaatagtaattcttttagctttatctaatgagatatcgcctttggcacgcaactcattacctaaatcaatatcccctttgttgctttcaattttaatatcgttttcagataaaataataccatcgtgttttacacccgcaccttgatccgttacgatcaatttaatgcttttaccgtgcattgcacctgtacttgcaccggtaattgcgacttcttctttatcggaaggctgactggtattactatctttttgtacttctaattttgtcttaccatcattctcaatgttatatgtgcttttacctttcccagcaataaaggtaatttctgtttccgatggtttgttcttttctttctctttatttccaattgtgcctttttgttcaattttcttcgcaacaatatctaagtaaggtaaattatccgttgcaaacccgttgacatctattgttactgttccttctgaaacatctagatccatcttgttaggatcgataagcttacttgtcgttgcaacaaaacgtcctgcgttaatggtttgcaccccatttaggttaataccatgttggttggcaataaccaaatcggcttttgtacctaaaatttccaacgcccctttaatttgactaagttctgaacccgttacctgatttaaaataactttcgcttctttgtctgctagattcttattaccttccagataacctactaattcagaacgttgttgatctttattatttttaaacaccgctccatttggaatattaaatttttggaaacggttatctgaaattcctttatcattcggtttcgcaatatcaatcacgataacgttattttctgttttgtatagtttagtaggatggttgttttcagttgtacctgcacctacgcctgcattttgattcttagtatctaattggatactgtcattaccatttttaatttcagttagctgaggcgttttctccgtttctgtcgcttcctctgctgactgtgcaaaattcggtgctgctaccatacttaacagcaatacagaaacgcttttccaatttaagcacaaagcggaagataccggatttaaaaaggtttttacggataaacatacgttggataagcggtagtcttcaattgatccctgccgatcttcctcgtctgttttttctgacacaacaacagaatcagatgaaccattatctatagcagatgtaatacattccgctacaggaactaaacaacctcttgtcttgctgaaaataagcttataacaattcttattcataataccttcctctaaactaaaaaatcaaaacgaaaccgaacctgtgaaataaaaaaccgacttcttgttactttcctcaaaagttcccactccattaataggcttagcataagtcaatgataatgcaagtgattttatttgagctttcacaccgaatgcaaaccccgcaaacgtatctacaacatggtgcggtcgttttgcatgaacttttcctatatcaatacccaaaaaagggttaatgtaagataaataactcttttgagggtaaaaaggaagcgtaactgtttgagaaatatagaaaccacgatcacctgagcctgccccacctttgaatcctcttaccgtatattcatctccaattgagaactggttctctccatataagctatcaaatccatattgtgcacctaaacgaaattgataactcattcctcgattaaaaaaaacaaacggtctctgccagttaatactgcctgaaaccaatcttaatgttttgtctctatgtgaattatatgcagaatgatttgcattaaaccacctcagtccattggaataagacagatcactataaagtttgccatgccccaaattggtcacataagataatcctatattcaatttgttattgtgatatttccctatgcgaatatcaccaaagtagctaagacgccttttaaactcaagttctccatataaagataaaatcatgtctttattacgcaataatgtgtgcgataacttaaatgacgcctgctttgtttccccactggatccgtgagtatgaattcctctcaactgtttcttataaccggaatatgataacttaatatccaaagtcgaaaatgagaaaggttgagtataagacaaggaataattttgttgccgatttacttgacgatccttataaatacgataacccgttgaaaaactccaacggtcattcgttcctaacagatcactccatgagatgcttaatgttgcctgatttcgaccttcggcattacttccttcaccggaattattcaggcttaaactaacctgcggataagaagtgcggtgcctctcaatgctcaaatttgacatacttttctcattcgctgcaatcacattcacctttgctgtcttatttcccgtatttagaatttcgatcagctgatccacgtcgtaaatacgaagtacctttccttttaaattaggcaaaacaaatagcattgctttatctttgaacaaagaagcctgctgttcttccactaaaatatcatttacttttccccaaagtacgacaaattccacttcaccgtttttgatctttgaagattttaaaccaatagcactggttacataaccggcattgtacaatacttgtgttagctcttttgtcaacgcaaacacggttttcgttgataaaggctgatttaaataatgttttatgacttcatcaaaatccagtgagatttcctctccacccaaatcaatagtaatcttcgtaattgtttgtatcgccgttgtggatttaagttgagtaactatatcctcttgatttggtcggttatcctccaaaaaacgttgtgctttctcgaaattttgctcaactttttcaaattgttgttgattttttaaatgcaataactcttgaaccaaaggcttagcctctttcgctgcttctcttgcttgcgtaaccaaaggatcttcttgtgcttgcacaactaaaggagcagcaacaaaagaaactagtaaacagcatgaaaataggatatttatcttgttatatttatattttggcataaaacgccgtccttccactttaattggaacaaattatactatacgctatttagacaactggtaataccagtataaatcattcttagcaatttcatcgtgtctttttcataatttttcataaaaaaatccccctttcctgtgctaaaaagaaaattgattatactgtagtttttatactattgaatggaatgaattacgcagtaattactttcttatttttatcttcgttttatcataactgtcattttcattaaataatactaatttcctctttaaatctctccttttttcgagtagattaagagttctcctcaaaaaattaagtaaccataaggaagaacattatgttattaactaacccagtagtaatttccattattgtgttactcgccttaagtcttatgcgaattaatgttgttatgggattagttatctcagcattagttgccgggctatgtagcgatttaaccattaatgaaacaataaaagcgttcacaggcggtttaggcgggggggctgaagttgcaatgaactatgcaattttaggtgcttttgctattgccatctctaaatcaggtattaccgatctacttgcttttaaagtaattaaacgcttaggtaagtcgccaacaggtaattcaatggctggatttaagtactttattcttgccatactagcgttattctcaatttcttcgcaaaacttattaccagtacacatcgcattcattccaattgttattcctccactcctttcaatttttaataaactaaaagttgatcgtcgtgcggttgcttgcgtattgacatttggattgactgcaacctatatgcttctccccgtcggtttcggtaaaatttttattgatagtgttttagtgaaaaatattaatcaagtaggtgcttcactcggcttaaaaaccagtgtagcagaagtctctttggcaatggcaattccggttatcggtatggttatcggtttattaaccgcagttttcgtcacttatcgtaaacctcgagagtatgtttcaggcggtttaaatgctacaactgaagaaatcgaaaagcacattgcaaatattaagcctttccatgtgattgtaagtgcggtcgcaattgtactcactttcgctttacaactgataaccagttcaacaattatcgctggtcttgtcggtctcattattttcgcagtatttggtatttttaaactaaaagaaagcaatgatattttccaacaaggcttaaaattaatggcaatgatcggtttcgtaatgattgccgcttcgggctttgctgcggtaattaatgcaactggcggtgtaacaattttggtggataatttcagccaaggcttgggtgcagaaaataaaggtttagctgcatttcttatgttgcttgtaggtctatttattaccatgggaatcggttcatccttttcaactgtaccaattattacatctatttatgtaccgctttgtctttcctttggattctcaccgttggcaactgttgcaattatcggtgtttctgccgcactgggcgatgctggctcaccagcctcagactcaactttaggtccgacatccggcttaaatatggacggtaaacatgatcatatttgggattctgttgtaccaacattcatccactacaatattccgctcattctttttggttggattgcggcaatgttcctttaataacttactttgagtgcctatggcatggcactcaaattttttaacttatgcaacaatctcctgttattatcttacttaaacaaaaagttgacgagtttttctctcgttattctcatataccttccaagcaaaaaatctatgccaaatttgaccgcactttatttagccaagactttgagagtttgtcgttttacctgaaagaaattcgtcaatgtttaactcaattagaaaaaatcaatgatgataatgtacaaaaatatactttttatagtgaaaaattaaaaggacaatgtaatgctctctcagaggcgttatcacaaacgaatgctaaaacaaacatcaaatttcagcataacgatacaagtctgcaatctgtacaagagcggcgggaaaaacaaagaattgcactgaataaacttcctccaagggagcgtttaagtaaatattatgaagcattacaggctttaaacacaaaattagaacgacaacgagattgctttgaagaggctacattattacaggataagcaaacctacagccaacaaatcgcaattacacaacaacgcaaacaacggtgttctgaggctattgaacaactggaagaatatttggctttattagatacaacctcagagaaataacgaaaatataacgaacatatttcacaagtatgtactatttttgtttaaattcttgcattaatcgcttgatctgccgatcattctttttaaatgctcgacaataaggacaaaataataaatgaatattaattgcacatttttgatagaacgctaattttttttcattactcaaagaaatcaattcagtaatttctttacaatttttcatctattttttccctccaaaccaatttttagataaacatgcctgtaactgaagtctagctcgatacaacaatacatgtaaattagacgtagaaatctcacattcctgacaaatttgttcgctatccaattctaaatactctcgcatcataaaaatgcgagcttgctgagctggtaaccgatttaaacaagcatcaaaaataacccaaaactcctctttataggtagcactttgaatatctgaccattcattaggttcaaaatggtttaaatcccaatgtcctttatcgttaaaaaacgcatttggtgcatcttcttcacagatttcagaaatattaatcattcgattacgactatgaattaagtcaataattttattttttaaaatggcaaatatccaagtttttaatgcagatttcccctcaaaagtgcggatattttttaaagcatttgttaatgcctcttgtaccacatcttcagctaaatcaaaatccttcagttgcaaaactgcaaatttgaccatttgtaagcgaacttcttcaagatccagttgagaaatatgttttatttcactcacaatcgttctccttgacaaaataatgtaagatttttcatcattctctgactatacaaattatacgtcaataacataggatttaagaatgaaaaaattaacttctcacgatgttacacctgaagaaattttccaccaacgtcgtaaaattattaaagccttcggtttaagtgcggttgcgactgcgttgccgaattttagctttgcacaagacagtaacggcttgaaatcccttgaatataaaaaatcgacagacacaactttaattttaacgcctgaaaataaagtaaccggctacaacaatttctatgaattcggtgtagataaaggttctcctgcacactatgccaaaaattttcaagtaaacccatggaagctggacattggaggtgaagtcgaaaatccttttacgcttaactatgatcagcttttcactcaatttcccttagaagaacgtatttatcgtttccgttgtgttgaggcttgggcaatggtagtaccttggattggttttgaactcaataaattattagaaaaagccaaaccgacaagtaaagcaaaatatgtggtatttcatactttgtatgatcctgagcaaatgccaggacagaaaaatcacttctttggaggcggtattcattatccttatgttgaggctcttaccctcgccgaagcaatgcactctctcacgttaatgtcggtaggtttgtacggaaaagcattaccaccgcaaaatggagcaccaattcgcttagttgtaccttggaaatatggctttaaaagtattaaatctattgtcaaaattactctatcggaaacacgcccacgcactacttgggaaagccttgcaccgaatgaatacggcttttatgccaatgtaaaccctaaagtggatcaccctcgctggtctcaagcctccgaacgggtcattggtgccggcggattattaagtgtgaaccgacaacctacactcatgtttaatggatatgaacgagaagtggcacatttatacaaaggattggatttaaggatcaattactaatgttggcattattacgtattattattcacttgagctgtttagctccattaatatggctttttttcgtacttttttcaggaaatgaaaccgcacttggtgccgatccgatcaaagaaattgaacatttcttaggctatacagctattttgattttctgtgctatgtttttactcagtatcctattgcaactattgaataaaaaccaataccaaattttacgccgtcctcttggtttatgggcatttgtattggcattattgcacgttgccagctatcttttcttggaattaggatttgatttctcattattcataaatgaaattataactcgtccttatctgattttaggcggcattgcttttctcattttgtcagtaatggcaataacatcgttgcccaaaataaaacaatggcttggtaaacgttggtttcaaatacaccagcttgcctatatagcaattatctgtgcggcaatccattattattggtcatcaaaaagtgtaactttagcaccgattgtggtaagcctagcagtgattgggatcgttatttggaaatatagcggaaaatatctcttaacatttttgcataaaaaatagacattttattgtataaaactctcctgattttcaccgcacttttccgctaattgaatgatcacttcatacaaaaagcgacaactaagtgtcgctttctacctttaagcaaaccatcctgcttgatgggcaataaataataatgtgaacgcagttaaatacactaaaccgattacagaaagccaaaataacccgcctcttatccgatgttcgccctttaatacaagcgaaagatttaactaggcaaaaataggcgttgaaacaaaagaagcaatcatggcaaattctaacattggaccgacagcattattgaagtaaaaaataatcgctaatccggaaagtgcagcaaataatatcgctaaatttaaggttcttaaactactttgttttttatttaaaattaaacgtaaacattccacatttgagcgagaatatccatcaattaccgtaattgttgtaccaaacatacacataaaagcaataaatgcaataagtgcttttgcccattcaccaatcgttgaagcatacatattaatcaattgtgcaatatattttccaccaaccatctgaacagtttcacctgaaccaaattggactagtgcgcccagtgcaagaaatacaatggctaaaattgcagtaccaatataaccgacattaaaatcccaaatgccgtcctcataagatatttttgaaatacggcgtttagcgactacccacattgaattgattgcagaaatttcaattggtgcgggcatccagcccatcaatgcaacaataaaagcaagtgcacttagactccatggatttggggcaatataatcttgcgaagcaacgccattaataccattacgcattaatgcaataattacagcagttaatgttgtcaatgttaatgcaatcataatgagtttagataaactatctagcaaacgatattgcccaaataacaaaataaataagctaacgccaataacaatcagactcaatgtaggaaccggaacagaaatcggtaatacaaaagttaaaatcgccgcacaaagcaagcctactgcggcagtattaataaccgttgaaaaaacatttaataagaaaaatacccatagataagatttccctttttggcgataaccttcaagtaacgtgttaccgctatctaaagtatattgcacaccaaaacgaaaaaatggatatttaaataaattcgctaaaagaataataatggctaattgccaaccataaatagcacctgcctgtgtcgacgcaataatatgcgaaccgccaacagccgctgaagccattaaaataccaggacccagtgcacttaatttttttgcccaaaaagattgatttacttgttgattttctttcataaaaattcctactaaccatctaacgaattaaaattctaaaatatttaaatataaaaacaagagaaaaataaaaaataaaattctaataaagaagatttataaacaaaaaataattatataaatccaaaatatttaactttactagattttaatgctattttttaaaaaataaaaagaaataaactctagaaattaagaagttagcaaacaaataaaaaacatataaaaagtaaaagcaaagaacacaatttctgtaacaagatgaaaaaccgaaaaataagatggctggggtactaggattcgaacctaggaatgccgagatcaaaacccggtgccttaccgcttggcgataccccaatagatattctaaatctgaattaactaagaagtgcttaagatagtatggctggggtactaggattcgaacctaggaatgccgagatcaaaacccggtgccttaccgcttggcgataccccaccaactaaagagttgcaagctaatgaatggtgcgggacgagggacttgaacccacacacctcgcggcaccagaacctaaatctggtgcgtctaccaatttcgccagtcccgcaaacatggtggctatgacgggattcgaacctgtgaccccaacattatgagtgttgtgctctaaccaactgagctacatagccatattatttgcattaccctcatcggctttgcggggctaattatgctgatatataccttactcgtcaactattttttaatgttttttttgatttcagtgttgttcgcatatagattatacaattcagataaaaagcatcttatactgtttttaataaccgtttatgattgatgtcgaataatccaacaattatgaatttgtttattccgttcaaaatctaaaggtaaagttttagcagaaatttctaccgcacttaactctaattcttgcaaaccgtctatatccattttaaaacctcgtttattattggaaaaaacgatagttccatttgttcgtaggatacgctttagatttgccattaacttaatatgatcacgttgaacatcccagctatcttccattcttttagaattagaaaatgtgggaggatcaacaaaaatcaaatcgaattgacgatcacatttattcaaccactgcaaacaatctgcttgaattagtttatgctgtttaccttcaatatcatttaacaacaaattctgttctgcccaatttaaataggtatttgacatatctaccgtggttgttgattttgccaaccccaacgcagcatgaaccgttgcagatcctgtataagcaaataagttaagaaaatctttccctacagccatttctcccagcattttacgggtcaaacgatgatctaaaaataaccctgtatccaaataatcagttaaatttacccataattttgcaccatattcatgcacataaaaatactctcccttattagcgagtttttcatattgactggtgcctttttgtttttgacgtacttttaaaattaatttattcgtttcaatacctgttaccgataaaatagcacttacagcatccaataaacgctgacgagctttattttcatcaacatttttaggtgccgcatattcttgtactataatatgatccgcatagcgatcaaccgccaaattgtattcaggtaaatcggcatcatataaacgataagcatccagtttttgttgattagcccatttatcaattttcttgatatttttacgtaaacgattagcgaaatcttgtgcaacttgtgtattttccgatacaaaagtcaatgttttttcttgcgaattttcaaccgcactttctacctgtttacgaacagcaatatggtaatttttttggacacaatctaaaggaccgttttttgccttaaattgacgatacgcacgtaaacgtaaacaatccagcaatacgggttctccactaaaaattgaaacgttccaatctgcaaactctgtttttaattgacgaccgaatacagaatataaagcaattaaagccggagtagtgcctaatctttcaccataaggcggattacaaatcactgttcctatttcttgttcagttggatttttcaatcctgcaacatcaccttgttgccatttaatgagatgtgagacccctgcattttgagcatttttctgtgctttcttcaatactcgatgatccaaatcaaagccccaaaagtgcggtgctaattttcgattaaatgcctgctctgcaagctcaactgcctcttgctttactttttcccatacaacttgattatgacctttccaaaaatcaaatccccaatgtaaacgatgtaattgtggtgctatctgagcttccatttgtgctgcttcaatcaataaagtgccggaaccgcacataggatcaacaagaggtgtccctttttcccaaccggaacgtaaaacaattgcagcagctaatgtttctcttaaaggtgctttccctgtatcttcacgataacctcgcagatgcaacgcctctccgctcaaatcgagagatacaactaactcatcttgatttaaataggcatgaatacgaatatcgggatactctttatccacatttggacgtgtttttccatgacgctcaaaataatctacaataccatctttaacacgcattgcaccgaactgagtatggcgaatttctctattagtaccgttaaaatctaccaaaaaagtgactcgttcatcaaaatgagtcaaccaattttgtccaacaatagcagaatataaatctaaatcactataaatttttgttgtaataagcggtaacaaaatccgagaactcaatcttgaccataataaaatgcgatactgcgtttcatcattcgcaataaagtgaactccaccttgtacaactcgacattcttgagcaccaagatccgttaattcaacttttaaaagttcttcaaaaccacgtgatgtagtagcaaaaagttgtttcattctatctctctataaagtaaaaattgggcgaaagcccaattaacattaatgattaaattgcgtgctatgtagctgtttataagcaccatttaaggctaataactcttgatgagaacctcgctctttgatttcaccctgctcaatcactaatatttcatctgctttctcaatagttgataagcggtgtgcaataaccaataccgttctatctttctgcaaagtttccaaagcggcttggattgcacgttccgactctgtatctaaagcagaagttgcttcatctaaaatcaaaaccggcgaatctcgtaataaggctcgagcaatagccaaacgctgacgctgtccgcctgataaactcgcaccgttctcaccaatcacggtatccaaaccattttctaatttttcgataaactccatagcataagccgcttcagccgcttcaataatttgctcacgagtacatttctctgtaactgcataagcaatattgttagcaatagtatcgttaaacaaatgaacttgctgtgaaacaaccgcacaatgttcacgtaaatttgccaaagtataatcttggatattcaccccgtctaaagtaattttaccttgttcaacatcataaaaacgagtaaccaagttggctatagtcgatttacctgaaccggatcgtcccactaatgcaacggttttaccttgcggaatagtgaaagaaatattattcaatgccggatgttcttttccactgtaactgaaagtaacattttcaaaccgcacttcccctttaactgtatctacaacatgtttccctgtatccttttcagtttcgagatctaataatgcaaataaagtctgacaagccgccattccacgctgaaattgtgcatttacgttagttaaagattttagtggtcgcatcatagcaagcattgatgaaaaaactacagtaaatgaacccgcactgagattttgtgtcatgatttccggtagcgttgccaaaaataaaacggcagcaagtgcaaatgaggctattatttgtacaaccggatcggaaattgcactagctgccataactttcatgcctctacgacgcatattattacttacttgatcaaaacgctcttcttcaattttttgtccgccaaaagctaaaacaactttatggccttttaacatttgttctactgaagaggttaaatctcccatggagttttgtaaattttttcccaattcacgaaatttttttgacactatacgaatgataatcgcgataattggaccaataataaaaagcaccaaagccaattgccagctggtataaaacattaccgtgagtaaagctatgatgtaagccccctcacgtacaattgtaactagcgaacctgatgaagaatttgctacttgttcactatcataaacaatacgtgacagtaacctccctaccgaattctgatcaaaaaaagtaacgggcatatacattaaatgcctaaacaatctacgacgcatcaccatcacaactttgcccgaaacccaagctagacaataagttgaaatgaaattggtgaccccacgaacaaatattaacaaaaccaccacaatagccattattctcaagagcgaattgtcaactttaccaaaaccttcatccaacaccggttttaacatttggatgagtgccgcatcagctaaagcattaaataccaatgctgcagcagaagcaattaagcctaatttaaaaggtgctattgttggccatagccgtttaaatgtttgtaatgtagaaagatctttatcttgcatgttcatacttctatcgtaaaaaaattgagtggcattatacatttatttaaattacaagccaattaatcctctataccaagggctaaactctgtccttgcggtttgaatttgaatatcttttcctttaaatgttaaacggatttggccggaaatggccgtattatagaccgcactttcaaccgcatttaagcgtttgacgacatcttgatgcggaaatccccacggattccaacgtccactggaaattaaagcaattttaggctgaatatgctgtagtaatttctcaccggttgacgttttactaccgtgatgtccgacctgtaacacatcaatcttacccaagtcagacaaaattttatattcagtcgccacatcagcgtctcctgttaatagtactttatgctgtccatctgaaattatcagcacacaagaatccggattattggctctcatcacaattttacttggcgataaggcttcaatatataacccctgccaatgccatatttttcctttttgacaagcaatatgcggtctattttctggagaattctcgtacttttttaatgagggactaataaactcagcattcggataagcttggaaaatatcttttactccacctgcatgatcattatcatcatgacttaatataactttatcaagaataataccctgtcttcttagataaggaataatctcaatttttgccatactaccatttttccagcttgctcccgtatcatacaaaattccatgttgattttttaccaataaacttgccaatccttgaccaacatctagagtatcaaattgccattgtgtgttttttaatcgcccttgttcatatagcgaaaaaaaccacagacataaaaaaataacaaacatagctgaactgaccaccataccatattgatattttttatgtgaaaaaccgtccgaaaaattcaaccgtatagggtaaaaacttttttttctaacttttctcaataaagataaatcatcgtcggttgaacacttaataatccatttacagcataaggtgaagagcaaagctaatatagctgaaataaaatagctttctgcaagagaaatattgatccactgatttggtaacagctttaacaattgattgatccatatagcaagctgatcagctatattccaactatttaacgcaccttccgtcagtacagcaaaaagaataagtggaactaacaaaaaactgaacaaaggcaacaataataaattagcccaaaatccatttaaggcgataccattaaaaattaagagttggataggtgtaaaaaaccacaaaagcccaaattgcaaatgaaaaagaccgataaaataccgcacttttttaaaggaagattgtgccaaaggcttttctttccataaaaataaatttagcggtatccattgataccacatgatcaaacagcctaccgctccgattgatagccaaaaactggctgacaataacataaatggattaagtatcagtaaaacacaaataacccgcaaaaatagttgccaaacattataggaaactcgacatatgcgacataaacaaactataaataaagcgacaatcgcacgaaaagtaggaattgaaaatcccgctaattctgcataacagaatgctaaaaaaatccctaatattaaaggaaaataaggttcaatataacgagtagggaataataattgaatagctcgccctaatgtaaaaccgatgaacatagctaacccaatatgcaaccctgaaattgcaattaaatgtgcggtattggtttgttgataaagttgccataattccttgtctagccatgctctttcaccaaaacccaatgcaagcaataaaccttgtgaaactaaattggaagtttgttgtaaagcttgattcagtcgagtagctcgccaagaaaaatcctcaccaattttcaccgcactttttactgtggcataagctgtaatttcttttgctaaataccaggtttgacgatcaaatcctcctatatttaatcgagaagaaatcggacgaatgtgcatatttacttgccaaatttcaccaacttgaacctcttgctcagtacgccaatttaaataaattcgctgtgttggcaaagatgaggtgaattttccttctgcgatcactgcttgatagtctttctgctgaataatttcagctattttaacgttagtttgtacttttttaggtaagcgggtaatatgctcactttgttccaacaagtttaatgcttgataatgaaaaaatcccaacccaagaacaaaaatgaaaaatagctttagaacacagcgaaaaaatactgctttaacaccaatatatcctaacccaagaacaagacataagatcaatatccattgccaattcaataaaaaaatacgaggcgtaattagcaatgtcattgcactcactaaaataacaaaaaggtaatgatcaaggttgaatttcattgataaattgaagattaattaattcttaatctacaatatgaaaaaaatacccataaaaaccaagtcagataaacttatcttggaatacaaatcacaaaatcaacaaaataatagaaaaaaatgaagagttaacataaatttatttgcttatttgagcaacttctgatatttatagcgcctttaaaatcagctgttccattttttggagtttttgaacaatcataaccagtttgcaaagtgctttcttaagttacaatcaattgtaagccacagaatgaataattattaggagatttaaatgtctaagtcatctttaagtttattagtgctcgccggcgttgacccttataaagaaaaaaaaagcgaagaatatatgaacgatgagcaacgttctcatttcagaaaaattttgcaggcttggcaaacacaaattcaggaagagacatctcgtactgtagcacatatgcaagatgaagcttcgaactttccggatcctgctgatcgtgcaacacaggaagaagaatttagtttggagttacgtgcgagagatcgtgaacgtaaattaatgaaaaaaattgaacatacattgaaaaaattagaaacagacgatttcggttattgtgattcctgtggtgtagaaatcggtattcgtcgcttagaagctcgcccgacagcagatctttgtattgattgtaaaacgttagctgaaattcgtgaaaaacaaatgatcggttaaccaattgatcaaatttggataatgtaaaaataaattttggaaacgttttttgatagttggtttgttagcttaaaagaaattttagaacataaatcaattgttagtgttaatacaaataaagtgcggtcttctctgccgcacttttgaatttttataaaactacaagatattaaaaaaggggtttattattttaaaatttattcaaaatctgttaagaaaaaaaaataaagtagctaaattaccaagctcaaatttgcctctaacagtttctacttcaaaacataaaactatctctcaggaaatgcgaactgagtcgccttttattgccacaaaacagcgatcgatacacaaaaatcaacacaataaatatgttgtcaaggcgtctcaatacggaattatgccacgtatgatcagtcgtaatgcactgtcagttgtagaaaaattacatcgtaatggttatgaagcttatattgttggcggttgtttaagagatttattattaggcaaaaagccaaaagattttgatgttgcaactaatgctaaacctgagcaagttcaagctatctttcaacgacaatgtcgtttagtggggcgtcgtttccgtttagctcatattatgtttggacgtgatattattgaagtggcaacattccgtgcagcacactcggacaatcataatgaacgccaagcaaaacaaaataatgccggtatgctattgcgtgacaatgtttatggaactattgaacaagatgccgaacgccgtgattttaccgtcaatgccctttattataatccgcaaaataatacattacgtgattatttcaacggcattgaagacctcaaagccggaaagttacgtttaattggcgatccagttaaacgctaccaagaagatcctgtacgcatgcttcgttctattcgctttatggcaaaactggatatgtttttggataagcctagccaagaacctatcaaaaaaatggctcatttattaaaaaatattcctccggcaagactttttgacgaaagtgtaaaacttttacaagcgggttatggtataaaaacttatcagttgttacgtgaatacggattatttgatcaattatttcccacgcttacaccttatttcaccgataaagcggatagctttgcagaaaaaatgattattaccgctcttacctctacagatgaaagagttgccgataacttaccaattaatcctgccttcttgtttgccgctttcttctggtatccgctaagagagaaagttgaaacactcaaaaatgaaggtagtttcaataatcatgatgcttatgctctagcaagtaatgatattttagatgctttttgtaccgcacttgccgcaccacgtcgtcatacaactgtcatccgagatatttggtttctacagcttcaactgcttaaacgcaccggttctgctccgatgcgagtcatggaacatgccaaatttagggcggcatttgatctcctcgttatgcgtgcacaaatagaggggggtgaggcaattgaattggcaacttggtggcatgaatatcaacttagtaaccaagatcaacgtgaaagtttaataaaagaacaacaacgccttaatccgaaaccgaagaagaaattttatcgttcaaaaaaacatcggaaatctacgctatcatcatgaagactgtttatatcgctttaggaagtaaccttgatacgcctatacaacaactaaatctggcactaggttcattagctcaactcaaaagttgtaaattaagtgcggtaagttctttttatcaaagtaaacctcttggtccacaagatcaaccggattacgtgaatgcggttgcttgtttaaaaaccgaattagatcccatagccctattggatcaattacaacatatagaaaaccaacaaggacgagtgcggttacgtcgttggggtgaacgtactttagatttagatattttgttatatggcaatgaaattatccaaaatgaacgcttaacaattcctcattacgatatgaaaaatcgtgaatttgttatcattcctctttatgaaattgcaccacatctcattttacctcatggcgaaaaattagcggatataatgctcaatttcactcatcatcaaatgcaaaaattataaaatttaaggcaaatatcataatatttgccttatttgctgaactaattttcaacttaaacattgttgaattttttttcgaaggatttgacgtcgttgactataaattacaataagttttccactcaccattcactgcggtaccaatcacgttaaattgattatcaaagacagttaagtttgcaatcttgcccacttcaatcgaacctaatctatcatcaacgccgattgcacgagccggatataaattacacatacgtaaagtttcatctagaggaacttcaacatatttcaccatattttctaccgactctatcatagtgaccgccgcaccgcctaatgtaccattagcgtcatagcattttccatctcgcacatagattgtttttccaacaaattgaaaagattcaatattggctccggcggcggctgtcgcatcagtcacaatacaaagtttatcgcctttcaactttttatccagtttgatattttcaaaactcacatgtaaaccatcggcaataataccgctataaatatcactatctaatactgcaccaacgacacccattgcacgtccagaactaattggcgacatagcattatgtaaatgtgttgcaaaacctgctcctagttgaatagccttttttgcaacttcatagcttgcattgctgtgtcctaaagaaaccaagatcccattttttacaaactcaggaatatgttttgcggttggattttctgctgctaaagtaattttagtaatgacatccgcattatcacataagaaagatttcatctcgggcgtaatttctcgaatatattcatcacgatgcacacctttacgctcaacacttagataaggtccttctaaatgcaaacctaatgcttgattttgatatttttccaaataatctcgcatgacttgcaccgcacttttcatcccttcatcaggtgaagtgataaaagtcggaagatagcttgtcgtaccggagcgtaaattcgtttcttgcataatctctaatgtgcggacactaatatcttcattaaacattacgcccccacaaccatttaactgcaaatcaataaaaccagcggttaaattattaccttttaaatcaatacgttgaatttcattacatagctgttcttcggaaacaatggctgaaattttatcgttttcaaccactactgcatgtccgtacagcacttcttttgccgtatagatcacacaatttataaaggcatatttcattttttcgtccttttaatcaagcacgctatgaatagcacgttgttccagttcagtaaaatacttaaccgtttttacttttaattcttgtgttgccggttcatcacaaacaaaaatagcatgacgatgtaattgcaatgcactaattgtccaaaaatgattaacatttccttcaacaccagcttgtaaagccaaggctttattatgtcctgttaccaacaacataacttcttccgcatctaataaagttgcaactccaatagtaagtgcatatttaggcactttagttacatcattatcaaaaaaacgagaattggcaattaatgtatcttctgttaatgtcttaattcgagtacgagaggcaagagaagatgctggctcattaaaggcaatatgcccatcaacccctacaccgcccataaataagttaatcttaccgtaagatttaattttctcttcataacggcgacattcttcatcatgatcatctgtattcccatctaaaatattaatattttgtggctgaatatcgatatgattaaagaaattattatacataaaagaatgataactttcaggatgttctttaggtagacctacatactcatccatattaaaagttacaacatatttaaaactcacttcctccgcttgatacagtttaattaactctttatatgtctgtaatggcgttcctcccgttggtaaacctagtacaaacggacgttctgcagtaggagcgaatgtattaatacggtcaacaatatattttgcagcccatttactgacttgttgtgctgtttttaatggaattaaacgcataaaatcaccttaattatttcaatattgtcatgtacaaaatgaagtgttatttcagaaatagaataataaataaaattatacactaaatctaataataattagcctatttcttaaaatagtgatctcaatcacagataaataaccgctacatttggattgttccacattgtgaaatatattattgagcaacattaatggtgtcggtataaaggataatataaaccttttgatttaccatttttccaacgcttgttgatcggattctcgatgttcaatccaacgtgtaccttggcaagtttgttcctttttccaaaaaggggctttgctttttaaataatccataatgaattcattagcctgataagcatcacctcgatgagctgtgctgacacccactaagacaatttcatcacccgtatttaacaaaccgacacgatgcacaactgcaactcgataaagttgccaacgtttttttgcctcgacaacaatttcctgcaaggctttccctgtcattgccggataatgttccaaatataaaccggaaaccgaatcgcccaaattcatctctcttactttaccgataaaaataaccgcagcacctacgctatgaggctcggttagccattgataaatcgcattttgatcaaaattttgctcttgaacggaaattttaatatctggcatttatcctcccgtaacaggtgggaaaaatgcaatttcatctccggaacgaaccgcactttccaacggtttaagcgtttgattaatcgcaaccaatagcttccctttctctaaagctaatgcccatttatcacctttttggctgagatgttgacgtaactgctctgctgttgcaaattccgctttaacctctaattcatcaacaccgattaattctctcgtttgtgcaaaaaataatacttttaacatctttataaattcacttcttgtctattcagcaataaaatgccctgattttccaccgctcttttcaagtaatctaacctgttcaataacaatgtctttttgtactgctttgcacatatcataaatggtcaatgcagcaatactggcggctgttaatgcttccatttcaacgccggtttttccacttaatttacatatactttcaacacgaacactacttatttcaggaagtgcggtcaaatttacttcaacttttgataataacaatggatgacacaatggaataagttcccaagtacgttttgccgcttgaattccggctatacgtgcagtagcaaacacatcacctttatgatgctgccctgaaaggatcatgttcaatgttgtcggcaacattcgaacgaatgcttccgctcttgcttcacgaacagtatcttgtttagcaaatacgtctaccatgttcgcttcaccttgatgattgatatgcgtaaatgttgtcatattttccttttatcctccaatactcgccaaatgatttcgaacaccgctatcgccaatatgtaaaaaatgatgttctcttttactttgcaatgctgtaaaaattcgactttttaattggttctgctgctcatcaaattgcaataaatctcgtagatcaattccttcttcaccaaataaacacaagtgtaattttccctttgccgaaactcttagacggttacaacttgtgcaaaaatttttttcataaggcatgatcaatccaatttcgcccttataatcaggatgtgcaaatacctttgccggtccatctgcacgttcttttttctgtatgctccacccttctcttataagtttttccgctaaaatttgacctgataaatggtattgatgaaaaaattgagccatttcgccggtttgcatcaattcaataaatcgcatttgaataggacgctctttgacccacattaaaaattgatcaaactccttatcattgagagatttcattaacactgaattcactttaattttttcataaccaatttcaaaagcacggtcaattcctcgcataatatcgtgaaatttatcaacgccggtaatcgcatgaaacattttaggatcgaggctatccacgctcacattgattgcactgattcccgcttttttccaatcctcaacttgtctagccattttgtagccattagtcgtcaatgcaatattttttattgtttcaatagcacgaatattttcaacaatggacaggaaatctttacgaagagtcggctcaccaccagtaatacgaactttttctgtacctaattgtgcaaaggcattcaccaatcgtttaatttcaaccagattcagaaaactgggttttgtgctttccgctcgatagccatgaggtaaacaatagttacaacgaaaattacacatatccgtgacagataagcgtaaataatagtatttacgttgaaacgcatcaataagatgattttcaataacattatgaatagaaatagatctttgcactagacacctttttaaataagaaaggataagtcgtttccaatattatccctgagcaattatatttgctggcattgtttccttatttttcaacttaggtaaacaagctcggagttatgcgataacgctcgtattttaaagaaatttaactcattagcctagtcttaaatgaatgaaattaaaaaattgtaatttagtacataaatttaagtgataaacattcaccttaagcatttcaatctttataataggtgaaattttatggagagatattatggcaacaattaaagatgtggcaaaaatggcaggagtatccacaacaacggtctcccatgtcatcaataaaacacgttttgttgcaaaagaaactgaacaacaagttttgcaagcaataaaaaacctcaactactcaccaagtgcggttgccaggagtttaaaagtcaatacaacaaaatctataggaatgattgttacaacctgtgaaactccctattttgcagaaattattcattccgtggaagagctttgttatcgacaaggttattctctatttctatgcaacacgcaaaataatccggagaaaatcaaaaaccatctcgacatgctggctaaaaaacgtgttgacggcttactcgttatgtgtgctgaatatactcaaaactctcttaatctccttgccgcattcgaagatttgccgatggttgtcatggattggggaccatttaatgaaaatacggatcttatccaagataacagtttctccggtggatatattgcgaccaaatatctgattgataatggtcataaagatattgcgattatttccggagaattaaaaaaaactaccgcagtaatgcgttatcagggatttgaaaaagcaatgcaagaagcaaatctggctatcaatcctgactggatcatggagggcttctttgaaccggaagatggctatgaatgtatgaataaaattcttgtgcaagataaactgccgactgcggtcttttgttgtaacgatgttatggcattgggtgcaatttcagcaattggagaaaaaggtttgaaagtgcctgatgatatttcagttattggttatgataatattcatgcctcacgcttcttttctccccctttaacaacgatacatcaatcaaaatcccgtttaggggtacaggcaattaacctattgtttaaacggattagtgaaaaggggaaagaacatgaaattatagaaatttatcctgagcttgttattcgcaaatcagtgaaaacgctataaaatctatcttaaaataaatctccataatatttttgtaggtatttatttttttatctattatctaattgaatatgctcaaacaatttctttaccgcattattatctcttaaacgttcagcttgctcaactaatgttcgggttaagtgcggtgagaaatattgaataaaatcgtacatataatttcttaaaaaaataccatgtttaaacgctatttgtgtcatactcgatctaaataaatggcttgcatcaagtgcaactaaatcattgtcagcctcagtatgtgccattgatgccattattcctacgcctaaccctaaacggacataggttttgataacatcggcatctgtcgctgtgaaaacaatgttaggcaataaccccgcactattaaaagcatagtctaaatcagatccccctgtaaaaccaaaggtataagtcactagaggatattgaccaagtgcttcaattgtcaatttcttacattgagccaaaggatgttccggtttgacaattactgagcgattccacatataacaaggcaataaaacaacgtcatcgaaaagatattgtgcttctgttgtaattgcaaaatcaacctcaccgaataaaagagcgtcataaatttgcgtaggagaaccttgatgaatatgtaaacttacttccggatattgtttagaaaaacgtctaatgacggaaggtaacatataacgagcctgcgtatttgttgtcgcaatacgtaaaactccacaatttggacgagtatattcattggcaattgctttaatattttgtgttttgactaataattcccttgccacggcgacaattcttgcccctgccggtgttaggcctttaatatgtttaccgttgcgttcaaaaatctctaaacccaactcatcttctaacaacctaacttgtttactgataccgggctgagaagtaaacaatgcgttagccgcatcagtaacattcatattttgattaacaatttcaacaatataacgaaattgctgaattttcatagcaatacctaaaatctcaatgagaaaaaaggtgcgtcaaaacacaccttccatgaaaaatttattgtggataacgagctgcgacttcagataatagagattgcaactctccctgttgaaacatttctagcattatatcacaaccaccaattaattctccctctacccacaattgcggaaaagtaggccaattagcataattcggtaatgccgctcgaatatccggatgttgtaaaatatcaacataaccaaaagggacattacaattaattaatacttcaaccgctcttgcagaaaatccacacgacgggaatttaggcgatcctttcatataaataagaattggattctcactgatttgttttttaattttgtctaaagtttccataatatctcttataaggtaaattcgggctgaattgtagcataatacaataaagccctaaataaatatttagggcttataaaatctactaaaggataacgatattatttgctacctttcactgagatttcaacacgacgatcttctgctaaacaggcgattaatgctttgcgacctttaaccgcatcacatttcataccagtcaccggatttgcttcaccgtaaccaaccgcactaatggcatcttgagcaacacctttagagactaaataatttgctacagtatccgcacgacgttgtgataattttaagtttgacgcatcagaaccgatacggtctgtataaccggcaacagaaacttgtgcagtttttaattgtgcgatttcaccataaacaccgtccaatgtttgttgagcttcaggttttaatgtatctttagcgaaggcaaaattcacatctgaatttaagctgaacactttgtttactacttcaggtgccataaccggtttttgaccgaaacggtaagataagccaagtgttactgcaccgatacttggtgtataatctaagcgttcaccatcattcttaagtgctttaccaacgcctttaacccattgatattccaaacgtaatgccaattccggtaaagaaggtaggctgtattcaacacccgctgcgaaaaccggagaaacttttaaagtgttttttacaccgtctgctgaattttcgaatttttcaacattaagataattagaacgaattaacgccgcacctacacgaccgtaaatatccaagccttctaatacagggtagctggcttttaagcctaattgcatcccttgagcggtatgtttagcttcgtctttacctttacgaccttttgcttgaccgaaatactcagaacccaactctacagcgacatgatcggtaatttggtaaccaccaaaaataccataagctactgaattacgaactgttcctttcttttctgcagaattttcaaattgattaagaccgtcatggaaagatgcccaaccggctttcgcaccggcatagaacgtatttgcttgaggtgccgcttgcacagaagcaacaaaacctgcgatagataacgcaataattgtttttttcatttgaatttcctctatattaattatcaagaaattaagcactacatgtattccgaagatttaaacatctctaggaattaaggtgggattttaacctaattttacaaaaaagataagttttttctctgatttatcttattaaagactaaaatttaagcaggttttccattttttttgctttaactaagaattcttttctttcatgacttgccatttgattacttgttcccggtaatttcactgttaacgggttaacaggtctaccgttaatatgaaattcgtaatgtaaatgagcaccggttgaacgtccagtatttcccgataatgctatacgttgtcctctttttaccgattgccccggtttgactaatgagcgacttaaatgcatatagactgtctgatattctttgccatgtctaatcattatataacgtccggcaccgttagcctgataagcgactttctctactactccatctgccggagcgatgatagtcgtgcctacaggtacagcaaaatcaacccctttgtgcggtcgtatttttcctgtaacgggatgacggcgagcaagattaaaaggagaagacaccctagcttgacgtaataaaggataacgtgcgaaacctttccctaaagtttctccctgacgactataatagcgtccattatttgcttggattgcgtaataactttttccaccggacataatatgtatggcttcgaccttgccttgcccagtcaatttattatctaaatactctctcgaaactaaaacggcaaacttatcccctttttttaacttattaagacttacctgccactgaagtgcggtagttaattgagcaatttgtttactgctcaagcccaaggctttcaaactggcataaaatgatccttctatctgtccttttagaacctcttctttccaaacacttttcttttctaaaatttgacgtttaaactgagattcattaactcgctcataaatacgttcttcacgttcggaaacaagccaatttaaatattccaaatttccatcattatccaatatccaataaatttgttggccagctttcaggttttttaattccggataactcgccatcatttgacgacttatttcctcatccaaccctgaatgttccaatacatctttcaatttatcgccacgaacaactgtatgtgcaaattgatctttaatacgcattgcttgatctgcagcatctaataaactatttaaggcatctttggcattatcgggcaatgatgatatttcattatccaaattaacttgatccgtttcatcatctaaaccgtctaaatcatcataagacaattcactgttatttttttcatttgcaatttgcatatcaacagatgtaggcttctgagaagaaacatcgtttctcaagaacaaccctatacccattagaataaataaaatagctacaaaaaaaacggcaacttttatgtagaatttctttttgcgtctatctctagctaatttaatgtgctgcaccattctaataacaactctataaaatttcagaacttcaataagaccgagaattgtactaaaaattcatttcatttcataaaaaaaattatacacccgcataatttatagacataaataattactacaccttgttaaaataaaaaaaataagctatttttctacttcaattttacctcagacatttgtttattatgcaaattcactctctaaaatatccattaatcgaattaaaaggcgttaatgtaacattcgcacaaaagaatattctaagcgatattaatttaacgatttatcccaattccattatgaccattgtaggaccgaatggaggcggaaaatcaacattactcaaagtactattaaaactgttgccagccacaagcggtgaagttatttatagcaaaaatgtcgtcattggttatgttccacaaaacatttatttagacaaaagtttgcctattaccgtagaaaaatttttatctttaagaaaagggacgcataaacaagatataaaagatgctttaacattactttccattggacatttacgtttgaacgctatgcaaaaactatctggcggtgaaatgcaacgtgttttgctggctagggctattttgaataagcctaatttacttgtattggatgaacctactcaaggagtagatataacaggacaagcagaactttatcaactgataaagcaaactcaacaacaactcaattgtgcaattctcatggtttcccatgatctacatcttgtcatggcagacacaaacgaagttctttgcgttaatcaacacatctgctgtgcaggctctcctgaggcagtatccaatgatccggtttttattcgtttctttggcaatcaattcgcaaaaaatatcgctttctatactcatcaccataatcataaacataatattcatggtgatatttgttgtggtcaagatttccggtctacacaatgtaaacacaaaataaattaaggaataaaaatgcttgaaattctctttcccgcttggctaaccggaatattactctcattaattaccgcacctttaggctctttcgttgtttggaggaagatggcttatttcggtgatacattggcacactctgccttacttggtgttaccttaggcatttttttacacatcaatccatatgttgctattctaatattaaccgtattattagcgatcttaatggtttggctggaaagtaatacgcaatactccatagataccttgttaggtattattgcacatagttgcttatctcttggtgtcgttaccgttgctttactgcaaaatgttcgtgtagatttgatggcttacttgtttggagatttattggcactgggatttgatgatctctattttattgccatcggagtaagcatcgtattaggaattttaatctttttttggcaacctttattatcaattaccgtcagtcctgaacttgctcaagttgaaggcattaatatcaaaagaatgcagtttctattaatgattttaaccgcacttaccattgcattaagtatgaaatttgtaggtgctttaattattacttcattactgattattccagcggcaacggcaaaacgttttgcaagaagtccggaaatgatggtgattattgctatttttgtgagtatgatttccatcacattaggattaacattatcagcattctatgatacgccttccggtccttccgttgttattagctctacgttcttatttattctttctttatttaaaaaagaaaataattaggtaaattacaataaaaagacgcaagctaaccaaaataccttacgtctttctttttattattgaaaaattaacttatttccagagagtaggatcaacgcctttacgaagtaattgagggtattgttcaattttaaattcaggatctttacccgctttgagctgttggcggtaatcttttagcaacaacataactatcggtgccaataaaacaatagacacaaggttaattaatgccataatcgccatcaccgtatctgcaaagttccatacaatatttcctgaattgactgcaccaaaatacacaaagaacaacacaattaaacggaaagtgagaataaacaatggtttattgcgaataaaacgaatgttactttctgcataagcgtagtttccgataatagaagaaaatgcaaataacaataggataaaagctaagaaatgtaagccaaattcaccaacatggtactgtaaagcatattgggttaatgaaatgtttttcagttgttcgccaccataattatctgataataaaataattaccgcagtacaagtacacacaataatagtatctacaaacacacccagcatttggatcaaaccttgacttacagggtgcttaacatctgccgatgctgctgcattcggtgccgaacccataccagcctcattggagaaaagtccccgtttaattcccattagcattgctttggaaaaaattgcaccgaacataccgccagccatcgcatcaaaattaaaggcactctgaataatacgacttattactgtcggtaccatttcaatattcatacctaaaataatcaccgcaatgattagataaaacaacgccatcataggaacaatttgtgcagaaactttaccaatgcgtttcacaccaccgaaaataattaaccccgttacgataactaaagttaccccaacatagtgcggttcccatttccaagcatttcttgtcgcttcaacaatggcattagattgaactgcattaaacgcaaatccgaacgtaaatattaaagcaattgcaaaacatactgccaaccaaggagctttcaatcctcttgtaatataataggcaggtccgccacgaaataacccgtttttatctttaactttaaataactgagccaaagaagattcagcaaatgcactggacattccaatcaacgccgttacccacatccaaaagacagcaccttccccgccaagtgctattgccgttgcaacgcctccgatattacccacacctacacggctggctaaaccagtagtaaatgcctgaaatggcgttaaagattgtccttgaactgcccgtccaaaccacatttcacgcaaactttgtggaaataaacgtaattgaataaagccggttgctaacgtaaaaaacgcacctaccccaagtaatgtaatagtcgctaaatcccatagtggtccatcaaatttatcaacaaaccaacttagtgcttgttcaatgtttattattatagttgaaaacataatctacctcccattaaattgaaacgtgagtatttaaatacaaatttaaaaaaaacaaaaacaaaaataattaaaatataaaacaaatattcttcaattagaaaaaatctaatattaaatcgtttaattaaataaaaaacaataaaaggaggttctacttttgaaaaaatactaatctcttgataaaaaaagtgcggctgcacctcgtacaccgccggaatcaccaaattttgcttttttaattaacggtactttcgctgtacgcattaaatgctgcggtaatgctttaggtaatgcttcatataaataatcaaagttggacaagcctcctcctaagataatcacatgcggatcaagtgcggtaataatattgccaattgaaatcgcacacagctcaataaaaagttcaacaaatttaaccgcactttcgtctttgtcataaaagcaccgaataatttctttagcggataacgcctttccttgtagatcacgatacaacatttcaaaaccacgaccggataagtaagtatccaaacacgctttattaccacaaccgcattcataaataggtgctttatcccaacctaacaatttcaaggcgtgataattaagttgcaaatgccccaattcgcccgccataccgctttgcccggaatggactttaccgttaaatactaaaccgccgccaaaaccggtacctagaatcaaacctaatacgacaggatattgctggttatctttatcccaagcctctgacaaggcaaagcaatttgcatcattttccgcccgcacttctctacctaaacgctcagatagatcttttaaaataggtttattgtcagcaacacgaatatttgtaatctctgcaataccggtttcctgattaacaaatccgggaacgccgatgccaactgtacctttacaggcaaatttttcatcggctttttgcactaaatgggtaatgacatttaaccattcatcatagctgtgtttgggtgtatccactctttcggaataacgtttctccaatttttcattaaatacagcaagctcaatttttgtgccaccaatatcaaatccgtaatacataaatcctccaaatataaccaataccaaccgcacttttatatcttgtcaaaaacaaaaatatcttttctttgtaaataagcaaatataatcaaatgcacaaaccaagcgattaaaatagaagccaatagatcaataggataatgcatacctaagcgtaatcgactcactaacattaacaccgcccacactgttacaacaggtactagcaatttaattttagggttgcgatgaccaagtaattgtgcaaatccaacaactaatagcagccaagttgccgcaaacattgtatgtccggaagggaaagaataacctgtttcattagcatgatgttcgatcagccaatcaggtgcggtctgttttgtctttgtttcttgataatattgatacactatttttttccgctcatggcgtttttgtgcataaaaatcatctgtactcatgtctgaattctgcactatttcttgcacaaaaggacgaggttcagaaaacattgtttttaaaccgctcttaatgccttgagtcaaaataactgaacatgccataatcacaattgcccatattgcctgttttttatcccgaattgcaacgaaataaaataaagcaaatgcaatacaagtgatgattgcataaggtgtgctacccgtttctgttaaaaaatataaaaaataatcaagcgaggcaacttcattaaattgccagtgccaatcaatgaagtaagtaaaaattggtacaacgcaaagtaataaagtatataatgaaaaacgttttaacatcttgataactcataaaatgaacttatataaggctcttgcattttaacattatcaagttataaaaagctaaaaataagtataggtattttattatgtccaaaattcagttagttgctgaagctaaattacccaccgagttcgggattttccgtattgtcggctttgagtttccagatactcaaaaagaacatgttgctcttgtaatgggcgatattaatgatgataaacctgttcttgcacgtatccattcagaatgtttaaccggcgatgctttacatagcttaaaatgtgattgcggtttccaactggcgaccgcattacgccaaatcagcgaagcaggacgaggagtattgatttatcatcgtgaagaagggcgtggtattggactaattaataaaattcgagcttacgctttgcaagatcaaggattagatacgattgaggcgaatcttgctttaggttttgctgctgatgaacgcaacttttcggtttgtgccgatatttttgcattactgggggtaaaacaagtacgtctgctcacaaataatccgaataaaattgaaaccatgaaaaaatccggtatcaatattgtggagcgagtgccattgaatgtaggtgaaaaccgctataacacagaatatctagatacgaaagcaaaaaaaatgggacactttattgtgcataataatgaaccacatttaatcacttgtccgcattgccaagaagaaattccgaaaaaataattttcataggttggcattccccaacctatatttttaactaagttgtccaataatttatttttctatttaatctttctcacttaattccggtattatgtagcagttgcacaaagaccaaaattcaatcttgaccgcaataaaatttctgatgcccttaactctcaaaatagcgttaagggcatttcttttgcttaattctaacttattttcccacacattagacaaaatttccttatcgcagacgtaaccaatcctctcaaccttgtaaaaggtaagcaactttcactaatacaaataggaatgtgattttgcgattaaaagttaagctgcaagtaattcctgttcatacttcatcatctcattgagatttttgaagtaggtttgggagatttcttcaggactgaaagcggtcataccaataagctcttgggtacggtgattaccttgccaatagcckacccattctcttaatggtaatacccataaacagcgtttaagaatattattgaacagctcaccattagacttacggcggttatctgacatataggcggcttgattagcataaagtaaggcgtatttattcgagcgatgatgatgtaccccacgggttaaatcacgctcacgggcgttaaaggattcggctaaattgttgtttacgccgcatttgctgtatgcctcttggtgattgactgaccaacgtgtgtagtgaaagtctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgtgtacaaggcactcaaagctaaacgccagacataaaaaatcgcccacctgaattttcaggtcggctcaaagcgttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgaagtagattagccctaaattttacaccattttcgcaaggttttaagctgtattttaggtgtcccaacgttaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcctttatccaattattcctagaaaatccatagtaaaggtagcagaataatgtgtaatttttttagtaggttaaaacagcattttcgcaaacatccttgttgctgtgtttcattagcatttttacttctattattactttggttagcagatttacttcttgttcaaatcatcactcctttccgttgtgatatgtggaaaggcaaagagctagaagtttttttaacccccgaagaatggaggaaactatcgggcgttaatgaatcattaaaagatactgagtggatacattatccagctattgagggaaaagcagaaaaagatcctttttttataaagaataagggggtatatcagccagtaatgtattttaatggtgatagacattggctaagtgaggttaatagtaaatacccttacttaaatatatatatcccaaaaagatactagggcataatacatttatcttatacgatcaaaatttaaaaaaaagaatagtccagtataatatcataagaggctatttccgtgatcctttttttggggtatcggggagttttgattgtaataaaaatgctatgtcagatggctcagatctgatagaagattatttaaaataactagagaggtaagatatgtctaatgataatttggcgttgttggctgctgctgcgtatggcgaattctctgaaataaataatattaaggaaattcagaaaaccttaataaaaaaggctgaagtatccgctactcaagctgaaaaatttacagatacttatgaaataatcgctcatcaagcaaacacggctagtggctattcagggactattgttaaaaataaatattttacatagagagatattatgaaaaaaaagattcttgccgtatttttaagtattattacgattatatttatttctacctatccttattcattttggcttagtgaagtagttgttagaatggtgattgctgaatttgaacaaataatatttccaattaaaagaacaaaagttttgaatagcaatggttttaatataaaagaagaaatatgtatcccttataaaagtttttttggtgagtatgcaattaatattgatctaaaagataaatcgctaaaaccatttgagacaaaaagcgttttattaaatgattttgatttttatatatctatatatgatgataaaaaccaattattattttataacagccctcaagacatcagagataagtcgagagaaaaatataattctgtaacactaaatgaatatatttttcctaaatcagggtgttataaggttaatgttgaaagtgtagatgtaaataatagcaagtataaatatttatatttacgtatttttataacacatgccattccttaaattaagataaatgtaggtgattattatgaaaaaatatactttagaagttaaaatagcagaaagaggaacctcatataaaggtcatagttcttctgttgctgggcatattttctatgtattagtagatgaacatggcaacagaaaaagttttggctggggaaaaggagagaattcaacactaggtggaatagagaacattactaaaacagatgacatcgattattcagaaacaaatttcggtggctccgatgatgatatgttatacggtggcgacggggcagataccttgcttggtgaaggtggtgatgattatttagatggcggagaaggcgaagatgttgccgagttctcgggtaattttgctgactataaaatcactaaaatgggtgatggcttattaattagcgacaccaaacaaggacgagatggtacggactttttacgcaatattgagaggctgaattttaaagatattacgaactatcaagtaccagtaaccaataattttaagccacaacttccctccttccaagcctaaataactatttaatcccccctcattaaaacctaattaaacatcatttaactttttgtaaaataaactgcgagacagatcacaaatttagcatttagttgtttgctattttgaaaaattccttatactcgctaaagaggtttttataccaaaacttaggaaaatttgatgtcttttattcgtattgtattgtgggtacttttaggctggttcttactttgggctgggaaatggggttattttatatataaagcacatgagtcgtttttgcctgacgtaaatattcctcttaaattacaaaaaggctataaatacgtgtttgaatatatccctccagatgcaagtttaaaagagcaaacatggtcattagagatagagggaataagttttaataaagaatatgaaagtcatctaaaaaacttaatgttaaatgatggtattgaacatataagtaaaattaaagaggggtatctttatccagcaccagtaataaaaactagagtaaaaaatctagaaacagatgaagtatatgagaatgtattatcttttcaaaacaagaactccagccatgtatgcaatgaaaccctacaaaatatttggtgttatcattatagagctgatgtactcacaggacaacgttggctaagatttttccctaataatagatatttaatagaaattgaagttctttattctgatattagacaagcaaatttaaaatcaaaacttgttctaggtgatgcacatttaaaaaaaacatatcgtttttaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaccgaagatttctcttgcaaaacctgtctctcaacaatgcctttctcttgtaatcttcttaatgcgtgtgaaaaggcagttacaatcgaatgatgctgagatttatgctctcttttcccttcaatctcaaatgccttaaacattatctcttttgctgacatccattggtttgggtaatgtttaaacacttttgyaatataatcgctagggtgataagcgtatattgaaatcacatttccattaccaatagatttagctttcctcttgataggacttgaaaacgggtcactctgtaatgccactaaggcttgttgtagagttacttgatgctctttcgccttttcaatacattgctcaaagtgmgwaatttgttgagyaagttcagcrattttctgccgaataaggrtttccccactcattcttgccataaataaaaatccttrtgatgtaaaataaccacaaggattttagtcaaatttagttaattggtctttgtgcaactgctacataataccgcttaattctgtgttaaaatccattttgcatttttaacccgatacaacggttacgaacaaatataggtaagataatgctccctagattaaaaaacattcctcaacttgatcctttagtttctgcctatttggaaaaattaaaaacgcaacattttgaaggtgatatcgcgacaaattatgcagaacgtttaagtttggcaaccgataacagtgtttatcaacaacttccacaagctattttatttcctaaaacaacaaacgatgtggtatgccttacaaagctagctcaacaaaaaaatttccaatctcttacctttacgccaagaggtggcggtacaggaaccaatggtcaagcaattaaccataatatcatcgttgatctttctcgttatatgacaaagatcttggaactcaatgtggagcaacggtgggttcgtgtacaagccggtgttgttaaagatcagctcaatcaatttttaaaaccctacggattgtttttttcaccggaactttctaccagtaatcgagctactattggcggaatgattaatactgatgcttccggacaaggctctctaaaatatggtaaaacttcagatcatgtactagcactaaaatctgtcttaatgaatggagaaattttagaaacaagtgcggtcaaatctgatgaatttttacaaaatattcagcatttatcatcaacaggacaaaaacttcatcaagaaatctttcaacgctgtcaacaaaaacgctcacaaattctcactgatttgcctcaattaaaccgttttttaaccggctatgatttaaaaaatgtatttaccgaagatcaaagcgaatttaatcttagtcgtattttaaccggatctgaaggttcattagcttttatttgcgaagcggttttagacttaacacctattcctcaataccgcactttaatcaacatcaaatatagctctttcgatgcagcattacgcaatgcacctttcatgctggcggttgaagcattatccgttgaaaccattgatagcaaagtactgaatctagccaaacaagatattatttggcattctgtacatgaattacttacggaagaaaaagaaaacccaattttaggtttaaatatcgttgaatatgcaggaaacgacctcaccttaattcaaaaacaagtatctcacttgtgtcaactgttagacgataaaatagctcaacaacaagataatattatcggttatcaagtttgctcagatcttccttccatcgaacgaatttatgctatgcgaaaaaaagcggtgggcttattaggcaatagcaaaggcaataaaaaacctattccttttgtggaagacagttgcgtaccgcctgaaaatctagccaactatattagtgagtttcgtcaattattagataaacatcacctagattacggtatgtttggacatgtcgatgcaggtgttctacatgtacgccccgctttagatttatgtaataaagaacaagttttgctattcaaaactatttctgatcaagtagcggatttaacaaaaaaatatggtggcttaatttggggagaacatggaaaaggaatgcgttcacaatacggtgaaaaattctttactccggaattatggcaagaattacgctacattaaatttttattcgatccgaataatcgtttaaatccgggtaaaatttgtaccgcactttattctgaacaagaactctactccattttgtcgccaatgcgggcagatcaagatcgtcaaattcccattcaaatacgagaggaattttccggtgcgatgaattgtaatggtaacggattatgctttaactttgatgttcacagtgccatgtgtccctctatgaaagttagtaaaaaccggctattttcgcccaaagggcgggcagcaataattcgtgaatggttgcgtttgatggcaaatgaaaatatctcgcctgaacagctgaattttcgtaaagtcgaagtgaaattaacagatcttgtcagaaaaattcgcaatactgttgcccaaaaacaaggggaatacgatttttctcacgaagttaaagaggctatgaatacttgtttagcctgtaaggcttgtgctacgcaatgtccaattaaaattgatgtgcccagctttcgtgccaagtttttctatttttaccataaccgctatttacgcccattgaaagattatgtggttgcaaatgtagaaatgatggcacctttaatggcaaaagcaccgaaatttttcaacttttttacaacggctaaactcactcaatctttggctgaaaatctgctagggatgactgatttaccctcattgtctgttccctctttgcaacaacagttagttgaaataaattatcaaggttattcattggagcaactggaaaatctaagtgcggtagaaaaacaaaatattttattgattgttcaagatccgtttacctctttttacgatgcaaaagtcgtcgctgattttgtagcactctgtcaaaaattaggttacaaagcaattgttctgccttttaaacctaatggtaaagcaatgcacataaagggattcctagcacgttttgccaaaactgcaaaaaatcaagcggacttcctcaataagataagtaaactcggtttatctctggtcggtgttgatcctgccattgttctttcttatcgtgatgaatataaagaaattctcggtgatgaaagaggagattttaatgttatcactgctcatgagtggttgaaacaagaattaagttcagggaaacttgagcataaacttacacaaattatgcaaaaaaataaccgcacttttaataaagaaagtcaacaaaaatggtatttatttccacattgtacggaaagtactacactaccgaacagtgcaaaagaatggcagcaaattttttcagcttttggacaagaattacacaccaaaaatgttggttgttgcggtatggcgggaacgtttgggcatgaaattcaacacctagagatgtcaaaagaaatttaccatttatcttgggctaaaaaattacaaggaaaaaatcctgattattgtttagctacggggtattcttgtcgcagtcaagttaaacgtatgctccattggcaacctaagcatcctattcaagccctattatcaattatttaaatagaaagaacttgttatgaaaatttggaaaaaaaactacacattagaccagcttaaccaattaaccgccaattgtgccgttgcacatttaggtatagaattcactgctcaaggtgatgattggcttgaagcaactctccccatagatcatagaacaactcaacctatgggatatttacacggcggtatatcctgtgcattagccgaaacagtagggtcagcggcaggtttttgttgtgttgatgaaaatcaagcggtacttggtgcagaaatcaatgcaagccatttacgccctgctacaagaggaaaagttacggcgagagcaacaccaattcggataggaaaaaatattcacgtttggcaaatcaatctttacgatgaagaacggaaaatttgttgtagctcaagactaacattaagtgtgatagcaattaattaacaattaaataacgttgctcgttggctattaacaccaatccacaacgcatgatttaccattgacatcacaagataataatttaggaagttatatagtgaaaaaagacaataaaatactcggcgtagtgctaggcatagggcttattttagtggggatatttatattaaacagtcccttattgactttattgacaattatttcgtaccttgcatgggcagttttgctcagggggttattttccctctttaaatgttataaatcacataaaaatacccaaccatttgataaaacagaattagccgctggcatcgtcttaatgattcttggcgtgatattcttaaccaacccttcatttaccaatgcacttgtattttatttagtcgccttttggtttatatttgaggggattgtcggtatatattatgccgccaaacaaaaagatgcagcaaaatgggtaggcattgtgctggggatttttctcgtattttttggcttatccatttcagtagaacctctcagagctatattggcactcaatctattgctgggattggcagtagtaaccaacgggattcaactcctaatcgttcaactgatgaaagagaaatagagggctaccgaatgaaaaaaatcggtattattcttgccaatttaggtacacccgatgaacccactcctaaagcattatctcgctatttatggcaatttttgactgatccacgtgtagtggatctacctaaatggcgttggtatccgttacttaaaagcattattttgcctcgccgatcagctcgggtcgccaaaatatatcaaaccgtttggacagataaaggttctcctttacttgtcatttccaatcaacaaaagcaagcgttacaatcccacttcgatgaacaccggattaatgcaacagtagaaattgcaatgacgtatggtaacccgtcaatggaaagtgcggttgaaaaactattgaaaaagcacgtgaatgaaatcatcttgttaccccttttcccacaatatagcagtacaactaccggtgctgtctttgatgcttttgcacaggcattaaaaaaacaacgcaacattgtgccttttcagtttattcattcataccatttacatgaagattatatcgaggcactggtaaatagtattaacactaaacacaaaccggatgaatacttaattttttcttttcatggcataccgttacgctatgaaaatgaaggagattattatcgtaaacattgtcatgaaacagttttagctgtagtagaacgtttaggcttgcgtgaaaatcagtggcaaatgacgttccaatcaagattcggaaaagaagaatggttgcaaccttatacggataaagtgttggaaaatatttatcaacgaaatatacaaaaagttgccgtggtttgtcccggattttccgcagattgtttagaaacaatcgaagaaattaatgaagaaaatcgaagaatttttctctctcatgggggagcgtcttttcaatatattcccgcacttaatgcagaaatgcaacatattgaaatgatgtataaattaatctcaagtagattataaaatcaactggtaaaatagagctgtaaaatactctatttacatctaaaaacattaatcttaaaatgccccgtcatcgcataccactgtcagttaaatttgctgatttatctttctaactctcaacgaattaaaggaaattgagatgaaaaaattaactaaaatgactttagctaatctgattttactcggagcaattcaaacagcgaatgccagtgataatactgtgtatctttatacatggagtgaatatgtccctgaaggattattagaaaactttactaaggaaacaggcattaaagttattgcatccagtttagaatccaatgaaacaatgtatgccaagctaaaaacgttggggaaaaacagtggatatgatgttattgcaccgaccagctattttgtgtctaaaatggcaagagaaggtatgttaaaggaattagatcacagtaaacttcctgtaatacaggaacttgatcctaatatgttagatagaccttttgacaaaggtaataaatactctcttccacaactattcggtgcaaccggtatcggatacaatacggacagtcaaaatccggaacaactgcaatcttggggtgatttatggaaccctgaatttgcaaataaactgcaaatgctggatgacccaagagaactatttaatattgcattactaaaaatgggggaaaatccaaatacccaagatccaaaggtaatagaaaaagcctatcaagaattattaaagctacgtcctaatattttagtttttaactctgataatcccgcaaatacctttattaccggtgaaacagatgtcggcttgatttggaacggatctattcgtgtcgcacaaaatgcaggcgtaccgattaaaattgtttatccaaaagaaggaaccatgttgtggattgataatttagccattccagcaacagctaaaaatgttgaatcggcatacaaactcatcaattacctgttaagtgcggatgtttccgaaaaattaacgctcgaaataggctatcctacttcaaatctcaacgctctcgaacgcttgccaaaagaattaaccgaaaataaaggtatcttcttaccgcaagaagtgcttgatcgaagtcaatggcaagtagatgtaggagaggcggctgaactttatgaaacttattatcaaaaattaaaaaatatgcaataaatacttccccgaaaagaactcatgaataatccccgtaaactgcggggattttatttatcagataaactatttttaaatatttttactcaccaacttaaatgaagtttaattcgctttatattcttcaatcacaacaggtaaagtcaaggttttatctaaacgctgtatgaccatatttattgtggtattaggtttagtattactaatcgcttccatcatttgagcaggagaaacagcatcaataccatcaaaactaacaatcacatcgccaggctgaataccggctttatgtgcagggctaccttgtaatattgatgtaattaaaattcctttatctcttaaaccctttccattgctaaatagaatatcactttgcacccctaagtaaccacgaataactcgaccatcacgaatgattttttgcataacatcattagctaattcaataggaatggcaaaatttaatccttccgcaatttcgttggcattcttaccaatacttaacgtacttataccaatcaattcaccagcagaattaatgagtgccccaccggaattaccacgattaagaggggcatccgtttgaataaaattttgtcgtccaatgaaatcgccaacagcattacgacccaatgcactaataataccttgcgacacactttgacctaggttatagggattcccaatagataaaacgacatcaccgacatgagcttgacgttttggattttgtggaatggttgccagattatctgcatgaatttttaaaaccgctaaatctgtcaagcgatccgaccccactaacttcgcttcaaaaatacgtccattttgtaatgccaccacaatttgatccgcattttgaacaacatgctcattagtcaatatataaccatcttttgacataataacgccggaacccaagttattaatttgtggctggtagttattggttgtaaatgcaaaagcttgattataaacattaactaccgccggtgaagcaatacgtacagcatctttataagaaagaatatctttttgtataaaaaaaacatttgtcaaatacccatttcccttgaaaacaggcaatataagtaacaccaatgctgcggcagctaacccagtgattattgattgaattaatttttttatcattatgtgattgccctcagtatcataaaatgtgacgctgataattcaacttaatgtcttcgccaatttgtgccaaagataacaattgccactttggtgcatcggctaaacggttcaaatgtggtaagtgacaaaagccacgagctttattacccagtaatttcggtgccatataaataatgagctcattcactaaattttcctcaataaatgcaccggctaaagtttctcccgcttctaaccaaagactattaatctgacgctttgccaattcaatcaacaagttttccaaataagaatgctcgttacttgggaataattttatatattgacaataatcaggaaacgctgacatatcacgctctttatcacccaccagccaaacgggagattgacattgaaataatttatgacgaggagtcacaagatgctgacgatcaagaataattctgacaggttgacgcacttcttcaactttataattttgttgtaattccgatggaaattgctcccaacgaagatttaacaagggatcatcggctaacaccgtcttagctgtcgataaaattgcagaaactttagcccgctcttgctgtacgtcttgccgtgcctgttctccgctaatccatttactctcgccattagccatagcagttcgaccgtcaaggcttattgccattttcaaaataacaaaaggtttctgtgttctcattcgtgttaaaaaacctttgtttaataattccgctttttcttgtaataatcctaccgcactttcaatacctgctgcttgcaacatagctaaccctttgcctgcaacttgcggattaggatctttcattgccacaataacgttgcgaatacctgcttcaattagtccttttgcacaaggaggcgttcttccgaaatgagaacaaggctctaaagtcacataagcagttgccccctttgctctatcaccggcatcacgtaatgccataacttccgcatggggttgccccgctttaaaatgaaaacctctcccaacaatttcaccatttttgactaaaacacagcccacagcaggattaggtgttgtggtaaatatgccttttttcgcaagatctaaagctatctgcataaaatattcgtcttgagctgaaaatgttggttgcatcactaatcctttaatttttcaatttcattggtaaattgattaatatcatcaaaactcaaataaaccgaggcaaaacgaatataagcaactttatccaattctttcaattcagccatcactaaacgcccaacatcttgacttttcacatcacgctcacctgttgctcgtaattgataaataatgcgactaattgctttctctacatcatcagaactcacaggtcgtttttctaaagcatgttgaatgcctcgacgcaatttatcttcatcaaaaggttcacgtgagccatcatttttgataattttaggcacaataacttccgcactttcaaaagtcgtgaaccgctcatgacaatatccacattccctacggcgacgaacctgataaccatcagaaaccaagcgactatcaatcacctttgtctcctccattgcacaaaaaggacatcgcataaaaaatccttaattaatcaaaaaaaaataaagcttatcttagcaaaatagacgtaacttgacgatatatttacatatcagtcaacaacgaaatgagagttcccttttagatttagaataaattttgacattcattttcttttaagcgtttaatgaaaaacatgttgtaccaaaaccatatacaaaacggtaccgactgcaatggataaaaacatgtttttttgccaaaaatgcagtactaatactacaataccagcaatgaaatcaggtataccacgatgacctgtcgtcagatcaatatttttatagcaatatactaccaacataccgaacattgctgccggtaatactttgcctaaatagcgaatatattccggtacagggcgattagctggaaaaatccagaaaggcaaccagcgaaaaagctgtacacctaaaattcccataccaatagtgattaactgttcatgaaaagtcacttatctctccctatctatccaatttagtcgccagtttttgcgataatattgaacggcgtaatgttaaatacaaccaaatgccaatcagtgttggaataagaaaaccctctttccctaccgttaataaagaaatcaatgcgattccgaagccaaataatgaactttcatgagatttttcttttaaccaattttcagcaaaaataactaaaaataaggctgtcattgcaaattcaacaccggcgagatcaaaaggcaaaatagaaccgaatagcgtacctaaagcagcaccaatgatccaatagcaatgtaaatataaactgacaaaaaagaaaaaccagcctctatctatattatgaggaatttttgccatatagtttaaagaaaaagcttcgtcaactaatgtggcaatcaaataccaccgttttttacccaaatctccgctgtatttctccagcattgagatggcataaaaaatctgccgcccactgaccattaatgtgattaataaaacgtgccaaggagaaaaagtactaactaatgctcctgcaataataaattctaccgaaccggcataaattaaggttgccattaaaataggataccaagttgcaaatccttgcactttcatatataccccataggctatacctaaaaacatgaatccggcaagaataggaaaagaatgaggcaaggctacttttgccgcattccatacggtttttgattgattaagatctgacatacaataactattctaaaatagacaatccgggcaaggtagaaaaacgttgagatttaataatctcatagaaatcatcaataaaggcaacatcattatccgtttctcggaaagcaccatagagatcactatataacccttcatcagtaatttttcttgccacaacatagcctctatccaaataaggttttactgcccaaaacggcaatgtcgccacaccacgtttacttgctacaagttgaataatagcaatggttaattcacttgtacgtcgagaaggattgatgcctttaggatgtaaaactttacgtagaagatcgagcatatcatcaggcacagggtaagttatcaaggtttgctcaacaaaatcttccgcttgccaaacctctttccccgccaaaggatgatcctttgcacacaaaccaaccatttcataggaaaacaagggcttatgaataatacccggcgtttcttcaatttctgatactaccgcccaatcggctcgatgactcagcaataaaccaatagcatctgtatggaatccagacacaatatcaagttcaactaaaggccaatgttgacgaaaattatccatggcaggcatcagccaatcaaaacaagtatgacattctacagctatttttaactcgcccgcctctccttgtttaattctcgataaagctcgttcagtctccatgaccttaggcaaaatttcattggctaatttgatcaaccgctctcctgccgctgtaaaccgcaaaggatgacttttccgctcaaataaaggtaattgatattgttcttccaataatttaatttgatgcgaaagtgccgattgagttaaataaactctctttgcagccaaagaaacactccctgtttcttttaacgcaatgagcgtttttaaatgacgcaattcaagaaaaataggtttcatgaagattttgataacaaaaaacaatttgccgtattgtacagcaaaataaaaggatcaaaaaggctttctcctctttgacccttagtcaactacatcaaggtaaaaccgatctttaccctatccacactaagtgcggttagttattgacaaatttttcgcctaattcaatatcagctcgtaaagttggcaacatatcttctaaggctttttgttcaaatgcacttaaggtacccaccggtaaaatttcctccaccccttcttttcctaagcgaacaggttgtgcaaagaaacgagcatatttaccatcaccttcaacatacgtacattccacaacagtttcaccacttagcccctgtaccagtgagagagcaaaacgtgctgctgcttgagccattgaaagtgtagcagaaccgccacccgctttcgcttcaacaacctcagtaccggcattttgaatacgttttgttaatggtgctatttcgtcctctttccattcggtatattgtacttgggataacaatggaagaatcgtcacaccggaatgtccgccaattaccggtaccgcaatgcgtgaaacattgagtcctttcaattcagcaacaaaagtttcagaacgtaatacatctaatgttgttaccccaaataatttacgtttatcataaacgcctgcttttttcagcacttcagcagcaattgctactgttgtattaaccggattggtaataatacccacacaggctttaggacaagttttagcgactttttcaattaaatttttcacaatacctgcattaatattaaataaatctgaacgatccattcccggtttacgagcaacaccggcagaaattagtacaacatcagcgttttctaaagcgggagttggatcttcccctgcaaaaccttgtatcttcaccgctgttggaatatggcttacatcagccgcaacacccggtgtaacaggtgcaatatcatataatgataattctgaacccgcaggtaattgtagttttaataacagagccaatgcctgaccaatacccccagccgcacctaaaacagctattttcataagaacctccttatactcatacagttacaaattgaaccgcacaaattttaaaatgatcaagttcttatttcaaacaaagaaattaaattgtgcgatctacctcaaatttttaacaaaaattatttttaaatgttgaaaactaagaatataaatataaaaattatctacctattttgcatttttatgcagcattccccaacgtcgatttaagagagaatacataatgatcaatgaaaaagcagatagcctagtcaacgcttttaaagagctactttcccaagaaagctttggttcccaaagcgaaattgttagtgctttacaacaaatgggatttactcatgtcaaccaatcaaaagtctccagaatgttaacaaaatttggagcagtgagaacacgaaatactcgtatggaaatggtatattgtcttcctaatgaattgagtgtacctaataccggtagcccattaaaaaatctcgtgttagatgtagatcataacgaaacattaattgttatcaaaaccagtcccggtgcggcacaactcatcgcaagattactggattcggttggcaaatctgaggggattttaggcacaattgcaggagatgatactattttcgttacccccaccacaggaaatgatattcaggttttaattactaatatccaaaaattattcgaaagttctttataggattgtgatgaggaacataagatgaaaatattcatcacaggtgccaccggattgattggctcaaacttaatccctctcttactggaaaaagaatatcaaattaccgctttagttagggacatggagaaagctcgtcatcagctacctaatcaagttcagttggtcaaagcactgtctcattatgagaatttcaatgattttgatggcgttatcaaccttgccggagccccgatttttgcccaatattggacaaccggctataaaaccgaactcattaatagtcgccttaatttaacggaaaatttaaccgcacttattaataacagtaacaaacctccacattgtttcatttccgcttccgcaacaggttattatggcgatcaaggaaataatctcattactgaaaaatctctgagcggaaatcaatttactgctcaattgtgtcaacaatgggaaaatattgctttacaagccaacagcagagtgtgtttattacgcactggaatggtgttttccgaaaaaggcggtgcattaacaaaaattctaccaatttatcgttatggacttggaggaaaactcggtaccggcaaacaattctgggcatggattagcttacaagatatgctacaagctattctgttcttgctggaaaatgcacaatgcgaaggtgcgtttaatctcgttgcaccaaaatctattcaaaataaagatttcaattgccaattaggtacatggctaaaacgtccttatttcacaacagttcctaaatttttacttaatttattgttaggtgaacgagcgacccttttattagacagtcaaaatgttattccacaaaaattattggaagccagatttcattttagcacaccgacattcagcgattttttacattcgataaagaaataggatatgttatttacaaaaaaaacaccgcacttaataagtgcggtgrkttttgctttgggtgtagcaagttagctaaattaccactgatamcccacrccaaccgaaccgccgacatcgccsgttgaactgcgagtaccttgyaatcgtagcgttattttaccgttatcactyactcgtgaataacctaacgcyaccgcactttgtcctttataggaacctgccgaagcagcaaacatggatttacccggcacagaagacatcggcaaacctgaagttgccaaagcmcccgcaatcccygctcgcaattctttattggacatatccagtttattgttgagattgctgagtttttggtcggyttgtctttgyaamgtatcyacatatttyttattcaccaccgcacttycaytsgtygwtgsytkaatatcmggyacggtaataataccgttttcaccrtcaatcttaatttcaccgtttgctccggttacggttaagccgtttttattaagaacarctttyggcatttttggattttgctgattttgtgctgaggtgttgtcggcaaaggtcaggctttcagcagttattgttgctttattgccagttttcttatcttccaacatgatattgtccgcaccataagttgccgatttgtckttgttgctaccatttttgttgttgacaacagttaagccatcgctatttaacgtcgattttttaccgcyctcctctttggtttcaaaggctttcatatttttcaacgtatccgacagttttatttctaaaccatctttggctgtattggyttctaccttratrttrccagcggcactactaaatgaacttgtagtttgaccgttttgagtttcctcttcccctttaatagttaaggtatcgctgattyttctgactacatcatcgccctgatttcctttaaatctcaacccagcttgtgcaaccgctttyaartcagcgagattrgcggcttgatgcagatcttgttgcycagtcatttkttgcccttgctggctacttatgccgttggaaaccagttttttcactagatcaagggatttaccttgtttttcagattcagrcttacctttcatactatcattatcaattcccaaggcggattttagatttttgatggcaacagggtcatgagccttacctccattttgaggtttaccgcctaaagtgattgattttttatsttcatcatcatatttcaccgtcactttatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctcgttgattttggagatattggcattaattgcatctttaaatgtgtctttagtcgcttgatttccaccacttgtatctttcaatgcagtaaatgtagttttcttaaagccatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccagctgattgttacttcactttgtcctgtgttttgtgtagttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggaaatttccccttttgaactatcaaggcttgctttgagatgttgtccagttttgaaagttaccgttgcacccaattgacgggtcatttcgcttgaagttccagcagaaccgcccgcacttgtgccgttttcgactttgaatttcaagccctcgttgattttctcaatgtttttggtaatagcgtctttaaatgttgttaaagctggatttgtctcagctccgtttttatctttcaacttagtaaacgtagtttgtttaaaaccggctttgttagtttcggctttttctgcacctaatacgtcggttcctaaatagccgaatacatcgataacgccttttaattgcccaccgttgatcgcatctgtggaaccgtccctaatttcacccgcagcaacatgtctaataactctttcacttcccatatcccctatacttagcacggattttttatcagaatcggatgcagatgttccagcattttcccatttaaataataggctataactgccattaacacttaactcttgtgttttaaatgcttgtttcttatcttctgccttagaacctttacctaaagcaatcgaatcccctgcattagtggatacagtcgcaccctcaccaatcgctaccgctccggcagcacttgcttgaacagttgcatctttaccaatcaccaccgcactttcagcttgagaaattgcatgtttaccgataatcactgaatttttggcgtttgttattgtgccattacttccaccgttctcaccatttcctattatgattaaatttgcattttcggaacctatattaagattacttcctattgcaactacattactaccggaacctgttagtgttattttattacccagtgctataccccatgcggaactttctatttttgtttctcctgatacaccaattgcgattgaagcatcactactttccaatacttttgctttataccccaatgctaaagattgttctgatttaacttgagtttccgcacctagggcagttgaccatttggcatttkywactaatgaaytayraccaatagcgatggcatcgtgtgatttaccattttctacttttgcactcacaccaatcgcaatggaattttgggcttttgctccgtcgttatcaaaattgtcgtttctgctacttgttgtggcggaagcggcggtgccatttcttaccgaaatataatgcaatttcgcttctgtaaattgtttgaagtttacggcatcgttatcttgtgaaccttcagcaacatttgaaattttgactttactatttccattagttccggtttgtgtaaaagttaatgcagtaccgccaacttttaaagttgcagttgatgtactatttgacccattactaaatgatagaatgttattattgtcttttcctacgctgttaataccttttaaggtatcgctaagtgctattgttaaatcacttccagaagacgtagtggtaatatttttatggctgccatttgaactatcttcttttcctttaatatttaaagtgtctcctaattttagagattgttctccgccagtatttccagcaaatttaagtcctttgtttatcgctgtgatggtatcttcaattgcttctctaaaagtagacttcctagcattagttccatttccattatatgagacagctgtaaaagtagtctttttaaaaccatctgttccagtatccgctttctccgcaccaagtacatttatccctaaattagcaaatacatcaattacgctataaagttgcccgccattgatagcatcggttgaacctgattgcactgttccggcggcaacattcgttattattcgttccttaccgctgtccccaatacttaaaacagacttgtcccctcctgctccggcattattccaagaaattgttatatcattagctcctgtagtagatataagaccggttggtgcggtctttgtcatcttcgcctttgagttcttacccaacgcaatagaatcgccagcnnnnnnnnnnnnnnnnnnnnnnnnnccaatggcgaccgcacctgttgcacttgcttgaacattcgcacctttaccgagtaccaccgcactttgtgctttggactctgcttctctaccaatcaccacggaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatattattccccaacgccacgatatctgtaccgctgttgattttgtttttattcccaagggctaatgaccattcggcattatctaattttgtatggtcagaaccatttccttcattaaccgcactgatagcgattgagccttttgcattgttgaatgtaacgccgttaccaacagcgacaacggcatcttgtttttctttactgctttgtgtaaccgtaatacctgagcctaacaacacggaatgttttacatcaacatccaagtccttaccaatcacaatcgcttgttcagcttttgatttcgcttcgtacccaagggcgatggcatatttttcggtcgcttccgcacccacaccgatagcgatcgcacctattttcgttgcaccatcgttgttgtagttgccttttgtgccactcgaactgctagaaccgctacctgcaccgtttgtaccatcattcaccgacaaataatgcaaagattgcgtaccagtactgcttccgccacttccgccaccgcttgtaattttgctatttacatagtctataactgcttttacagtcgttaattttttgtcatcgccgttgctgttaccgcctgatgtgctgttaattgaatcagttgcattgacttcaaacttaatttggtccttaccactactaccttcagtgcttaaagtcagatagtcgtcgcctttaaaggtcaatgattgtccgagttgtcttttgatagtattgttgttactgctaccacttccatttcccccaactttaaaggtcattccttggtttatggctgtaatagtgtcttcaatcgcttctctaaacgtggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacttgtgcacctaatactttggatcctaattctccaaaaaattcaattaccctaaataactgtccgccattgattgcatcagttgaactacgtcctacatttcctgcagcgacatgttttatcagactttcgcttgaaccacttcctacattaataacttgtttattagaaccagtaccagcatttttccattttaatattatagaatctaaaccaacattaatgtctgtaccatcaagtgcggtttccatagtccctttcgaaaataaatcacttaaccccgtggctttggtgattttttggtttatgtcgtcgttgagtttgattttgatggggctacttgaacaattgtgtattacttgagagtttgaactcccaaatccccctcctactccattgctttgtttactacaagtaaatgatcctacatctacatcgataaaaccttctccctttatccccgttttcatcatattttcgacatctttcgcttcaccatcttgtaatcctgaaacaccgggtgaaaaaccttgtcccaaaacctccaccggcaacrccaccgacaacgctaacgccagcggtgcgagtttaaacgccccgaaaacaccgaaaaacacaccgcacttcggcttactctccgaactgctctctatttggcgattacttgccaactcggaaacggctttacattgacctgttgtaatatcatatttggttttgaagattttgttcatattctttactcactgtttgtttattcatctgtttttttgggtttttgttgtgtttttatatttatagagcagttataaacstaagcggaaaattgctttgctttttaaggcawagcaaaaaaagacgaatgatattttcgccgagrggttgaaaagggaaaaykgggatatttttaraggttaataatrtaaaaaataggttgcargryttgcaacaaggcgttagcctagactgtagactgtagactgtagactgtagactgtagactgtagactgtagactgtagactgtagactgtagactgtagactgtagactgtagactgtagactgtagactgtcatttttcctgttctattttatttgtcaagtaaaaattcttgctatcctatcctaaatttttatagaaagaaatgatttttttactttttatcctaacttgattgaggcgaacaattaaaatgtttgatattcaaagaggattaaatcatcaccgcactttttagcataacgaaaaatcctagctccctatggggtaagatttcacatttatatggcacgatcagataaaattgaacgcttaaaagtgcggtacattttacagagatttcatttttctgttgttcttacgctgagaaatagcgataatgtgcgatctagaaaatccattgaaaacttatgatagattatattttactgattattagtaccgcactgattaataactttgttctagttaaattcttaggactttgtccgtttatgggcgtttcaaaaaaaattgaaaccgctattggcatgggattagcaacaatgtttgtacttactgttgcctcgttgtgtgcttatttagtcgagcgttatttactcactccactccatgcaaatttcttacgcaccttgatttttattcttgttatcgctgttgtcgtacaatttactgaaatggtcattcataaaacgagcccaacactttatcgtttactgggtatttttctccctttgattaccactaattgtgcagttcttggcgttgcactgcttaatataaacttagctcataacttaactcaatccgtcatttatggattttctgcgtcgcttggtttttctcttgttctagttttatttgcgggattgcgtgaacgtcttgcagcagcagatattccccttccctttcggggagcctctattgcgttaattaccgctggattgatgtcacttgcttttatgggctttaccggtttagtgagagtgtaaataatggcaacattacattacgttctgccggttgttgttttgcttgccgttctttttggggtaatcttaggctttgcctccattaaattaaaagttgaaggcgatcctatcgtagaaaaaattgatgcgttgttaccacaaagtcaatgtgcacaatgcggttatcccggttgcaaaccttatgctcaagctattgcgaatggagatgaaatcactaagtgtgtacctggtgggcaaccattagtcatcaaaatagcagatttattaggcatagaagcacctagcggtaattttgaaaaagatcctgtacccaaaatggcattcattgacgaagatatgtgtattggttgtacaaaatgtattcaagcctgccctgttgatgccatcattggtacaaataaagcgatgcacaccattattgccgatctttgtaccggttgtgaactttgtgttgcaccttgcccaacagattgtatttcaatgatcaacgtcaaacaacatattgataactgggattggaagttcgatcctaagttagttattcccatcgttgatactacttcagcacaaaagaaaatcgttgtaggagaatagggaatgacacagcgtatagatatattaaccaattacaattcaggtaaactttgggatttttatggaggtattcatccgccggagatgaaatctcagtcgaaccaaaccccgataaaaaacttgcctttagctaacaccttttatgttccggtcaagcaacatgccggaagtgcgggtaatattttggttaaggtaggagatagagtcttaaaaggtcaagccttaacgcttggctcaggtttaaacgcattgcctgttcatgcccccacatcaggtattatcaaaaatattgccccttatgttgccgctcatccttcaggtctatgcgaattaagtattgaaattgaatccgatggattggaacaatggcgaaaacgccactcaatagaggactttttaacacttagccgagaacaactcattgataaaatttatcaagcaggtatcgcaggattgggcggtgcggtttttccaaccgccgccaaaattcgatcagcaaacaataaagttaaactattaattattaatggtgcagaatgtgagccttatatcacttgtgatgatcgcttaatgcgtgattacagtgaagaaattattgagggtatacgtattctccgttatattttacgtcctgaaaaagtggtaattgctgttgaagataataaaccggaggctatcgctgctttacagcaaagtttacatggtgctgatgatattgatattcgtgttattccaactaaatatccttccggtgcagcaaagcaacttatccaaattctaactggcgttgaagtggcaagcggacaacgctcttccagtattggtattttaatgcacaatgtaggaacagcatttgccataaaacgtgccattattgatgatgaacctttaattgaacgagtggttaccttaaccggagataaaattgcacaaaaagggaatttttgggttcctttgggaacgccaatttctcatgttctaaaacaagtcgcttatcaatatgactcacgcttccctgtttttatgggcggtccgatgatgggctttatcttacccaatttgtatgctcccgtaactaaagcgactaactgcttgctggcaccggatcattttgaatatgaaccgccggcaacggaacaatcttgtattcgttgctctgcttgctccgatgcctgccctgtacatttaatgcctcaacaactgtattggtttgccagagcggaggatcataaaaagtccgaagaatacgccctaaaagattgtattgaatgtggtttatgtgcctatgtttgtccgagtcatattcctctcattcaatatttccgccaagaaaaagcaaaaatttgggaaattaaagaaaaggcacaaaaatcagaagaagccaaaattcgttttgaggctcgtcaagctcgcttagaaaaagaagaacaagaacgcagagcaagggttaataaagcggcagaaaatcgtcgtgcggaaatggcacaacaaaaaggaattgatccagttcaagccgcacttgaacgcttaaaagcgaagaaatcaatcgaaacacgtgaacacaaccaagaacagaaaacgtttataaatattaaaggcgaaatattgcctgataacagcgacatcatagagcaacgtaaagcacgtcgtttggctcgtcagcaaaccaattcaaacagcattcaagaaattgaaactgttgtacaaaattcggagaaaaatacagaaaaaagtgcggtacaatctggcgtagatccgaaaaaagccgctgttgctgctgctattgctcgtgctaaagcaaaaaaacaggcttcacaaattactgcaaatagtattttggagcctgatactacaatacaaaatacagaaaaaagtgcggtgcaatctgacrtagatccgaaaaaagccgctgttgctgctgctattgctcgtgctaaagcaaaaaaacaggcttcacaaattactgcaaatagtattttggagcctgatactacaatacaaaatacagaaaaaagtgcggtgcaatctgacatagatccgaaaaaagccgctgttgccgctgctattgctcgtgctaaagcaaagcaattagcaaaaaaacaaattgaagttaccaataaatgaaacaaagagattttacatgtttaaaatgattagctccccacatactcattcggggaaattgacagcccgcataatgttatgggtgattgtggcaatgttaccggcaatcgcagggcaagtatattacttcggatttggcgttttaatccaatcactgttggcaataagtacggcgttatccctcgagtttgttgtaaccttattgcgtaaaaaaccaaaatttttttatattggtgattttagcgttgttttgaccgcacttattctcgcagttgccattccgccttatgccccctattgggttattattatcggtacatgttgtgctgtaattttaggtaaacatgtttacggcggattaggacaaaatttatttaatccagcaatggttggctatgtcattttgcttatttcatttcccctacaaatgacaacttggttacctccaattcaactgcttaacgaaccacctcattttgccgatgcgtataaactcattttccaaggtgttaccactgacggttttaatttaagccaattaatattggctattgacggtatgagccaagcaacgccattagacacagttaaaacagcaatgcgaaataatttatcttcattacacgaagtcagctcatcacctattttcagttcggttctaccattgggcaaaagggatattgttgaaggaatgggctggacacaaataaatttactcttttttctagggggtatcttcctaatttggaaaaaaattattcattggcaaattccaaccgcacttttagcaactatttttagttttgcattgttgaactggctattttcctcagctacaccaaacccaatttggcatttagtcagcggtgcaacaatgtttggggcattctttattgctaccgatccggttaccgcttcaattacaccgagaggaaaactcattttcggtgcattagtcggattattaatctgcttaattcgtttttggggaaattatcctgatggcgttgcttttgctattttactggcgaatatttgcgtgccactaattgatcattacactcgtccacgtgttataggtcataacaaaaaaggaatcaaacaatgagcgttgcacaaataagtagaaaatatggcatattgttgggaacagtcgcctttatttgtaccgcactttccggtgcggtatattggctcacgaaggataaaattgcttttacgatagctcaacaagagcggtctcttttagctgaggtaatgcctaaagattattatgacaatgatctgttagccgactgcaaaatgctctcatcttctttggcaaaagaatatcgtattaataaactttgtacagcaaaaaaaaatcagcaaattagtgcttacgcttatgaaactatcgcaccggacggctactccggcaatataaaaatgttggtcgcaattacacgacaaggcgaagtgctgggcgttcgaattacggaacatcaagaaacccccggtctaggcgataaaattgaattacgaatttccgattgggtactgaattttgcccataaaatgttacagccgaacaatttaaacgattgggcagtcaaaaaagacggcggtaaattcgatcaatttaccggtgccacaattacgcctcgtgctgttgtaaatcaagttaaaacttcagggataatacttctaacacaacttgataaacttgctgtggagaatgaagaatgagtacaaaaaatctacccgaaacacaccgcactttagatgaatttgaaccctctcatttgactgtaaacaaggttaaaaccgaaagtgtatgggtaaatttatttaaacaaggattttggcataacaaccctgccctagttcagctattaggactctgccctttacttgcggtatcaaattcagcgataaatgctttaggtttaggcattgcaactattatcgttttaatttgtagcaatactgtagtttctttgtttcgcaaacaaatccctcaagagatccgtatccccatttatgtgatgattattgcgactacggtaacgatagtgcaacttatcatgaatgcttatacttacaccctttatcaagcattaggtatttttattccattgattgtgaccaattgcattgtaattgggcgtgcggaagcgtttgcctcaaaaaataccgttttacattccatttttgatgggtttgctatgggacttggcatgaccttcagtttgtttattttaggtgcattacgtgaaattttcggtacggggaaattattttttggtatagaaaatttatttggcgactgggcaaaatgtttacaactgaacctatttcaattagacaatagtttcttactggcaatcttaccgcccggagcgtttatcggtctaggcattatgttagcaataaaaaacgtgatagatcacagaaaatgaataaacaaaaacgtatcgaaatattaactcgtctgcgtgatcaaaatccgcaccccacgactgaattgcattttaatacaccttttgaattacttattgcagtcattctctctgcacaagcaacagataaaggagtaaataaagcaacagataaactttttcctttagctaataccccacaagccattttagatcttggtttggatgagttaaaaaaatatataaaaacgattgggttatacaatagtaaagctgaaaatattattaaaacttgccgtgatttaattgaaaagcacaatggtcaagttccggaaaatcgagaagcattggaagcactggcaggcgtaggcagaaaaacggctaatgttgttcttaatacagcttttggtcatcctactattgccgttgacacacatattttccgagtgtctaatcgtacaggatttgctcccggaaaagatgtcgtaaaagtagaagaaaaattattgaaagttgtaccatcagagtttaaagtggatgtacaccactggttaattttacatggtcgctatacttgcattgcaagaaaaccgagatgtggctcttgtattattgaagacttatgtgaatttaaagaaaaaacagagatttaacataaattataaatagaaacgaaggtataacattatgacaaacaccccaaaaagacaaacttggtccagtcgattaacctatgtcatgacagtagccggagcaaccgttggatttggtgcaacttggcgatttccttatttagtaggtgaaaatggcggcggtgcttatgtactgctcttttgtattgccatgttagttatcggcattccaatgattttagtggaaaatgtcatcggtcgtcgcttacgtgttaattcaattgatgcattcagtgataaattagaaggaaaaaatatttctaaagcgtggaaaattattggctatatgggattactcggtgcatttggtattatggcgtactatatggtacttggtggttgggtaatgaattatatcatcaatctcattaccggttccctagatatttcatcggtaattaacaaagaatatgcccaaaatttttatcaagagagtattactgaaagtccgctacaaatcataatttatacactgatttttgtcgtcattaactatattattcttgctaaaggaattattggcggcattgagcaagcggtaaaatatttgatgcccttattgtttatttgccttatcggtatggttattcgtaacgttactttaccgggagcaatggaaggaattatttattacctcaaacctgatttttctaaaatcacgccacaattgtttatcctcgtacttggacaagttttctttgcactaagtttgggatttggtgtaattatcacactttccagttacctcagcaaagaagaaaatctcatccaaaccgccgttataaccggatttacaaatacaattatagctgtcctgtcaggctttatgattttcccgtcattatttacttttgggattgaaccgaatgcaggaccaaccttagttttccaaagtttacccattgttttctcacacttatgggcagggcgtatttttgctgttgtcttctttagcttactgctcatcgcagccctaacaacctcaatcaccatttatgaagtaattattaccgcactacaagaaaaacttagaatgcgtcgtgcaaaagcaatttttatcacgttaggcacaattttcttaatcggtaatattccatcaatattaagtgataatttgttaaaagacgtcacattctttggtaaaagtatcttcgatacgtttgattacgtcagcggtaatattttatttttattgaccgcacttgggtgtgctatttttgtaggctttgtactaaaagaagatgcgataaaagaactctccccaaatccaaattctttatcgactcagatttggttcaattatgtaaaatttgctgtaccattaattattatcgtgatttttgtaagtaattttgtttaatctaaaactgtttaatttatagaggacactatgcaccatatatttatctcagataaaaataatgatatccgtcgtcatcatattgaaaatgaaactaaaaaattagggattacccctaatttttatgatgcaattatggcacgtgatttatcaaaagaagaattatcaacgcttactatccctaatacatttttaaccccaggagaaatttgttgtgcaaaaagtcatctagaggggggggrgtaaaacgattgttagaaagcaatcaagaatacatttttatttttgaagatgatattctcttttctgataactttacgcctgaagtcattaacgaaattacaaactttatatcctctttgcaaaatccatctattctagttttatttaacagcatttataaaaagaaaaaagtaaaagatcttaatagtgctatatctattttttctgctcacaatttattctatgcttgtggctatgtcattaacagacaagcagcagaaaatattctaaacatccaaacgccaatcaagtttgaaattgatgcttttaagttttattactggttagatgcctgcgatttatattgtctaaatactgacttagtaaaacccgctccagaaatttcaaacttatcagagatagattgcgacaaccctagaaaatatacaaagcaacgcacaattaagaaaaataacgcatatcgtcttttatacaatcaactgagttggcaaaataaattaaaagcaaatataaagagaatacaaaaaatgttacataaaccctttgaaaaattgtagtttgtaatacattctaaatgggtagctttgtaggcaaaaatcaataatctaactttttaggttagattatttctgttatttactcctttaagatacctaaattccaattttctgctgacgttggacgtttttcttgcaataagaaacgttgatttgcctttgcttgaggttgtattactttactggatggtgtagagaaagaaataccgcctttaagcaattgctgcatggttcccgtattaatggacaatccgctcaagccaatttccacaccgtacccggaagaaatccaaaactctgtattttggcgaacaaagtgttggtatttcttagcaattaataaatgaactaaaactcgatcacctaattgatttagttccagtttagatatagtacctacctctataccacgatacatcacaggggatccgatactgatgtttgtggcatcagtggcttctagaataattggaaagccgttgccgtatttgtttgccggaggtacggacgaaagcaatttaaagtttgttttttttgcaccttgtccaatttctacgtcaatataaggttgtaataaactatcaatattatcaatgccaccggctgaaatgtgcggtgaaatgaggcgaaatttactgttttctttcgcaatgatattcatgtattttgcatgaattaatgcagtagccttgattttatgatcttcggttagattaatttgctctatttctcctataggaagccccatatagcgtagtgccatacctttagtcaagtttgttgcatcatcagcgataaacgtaataacttgttctgccgatttggctttcatttcatttgcataaagggttctattgcttcctgagcctgaattatcaaaactgaccgcacctttcaaagaacgggcgataggggttgcctgaatactaattccctttggcgttatatcaatttgtgccgcactttctacccaaaaaagacttttggttgtgagtaaatgtttatatttggggtaaataaaaacatcaacttcaaaatgattagcggttggtctaatatctaaaatcttaccaacttcatattgacgataaagtacaagcgagcttttatttatacttggtagattttttgtagttaacgtgatattaggctctaaaatattatcggtaataccgaattctgcactggttaaatccttatacaaaggatattcttgttgtgcttgtccttcctttttaccgcttgatataaccctaattcccccttgcaaccattttttcggactagcagcttccattcttaagccatcaatacccaaactaatatcaaagttactcgctgcaataaataatgtatttttatgaataagttgacgatatttttccgctattgctacttggaaaataacgcgttccggtgtactggtaatgttgacaatttcaccaatattttggtgattatagtaaagtgattgcccttctgtaataccgtaggtttcgggtgaaatgaggtttattactagggtattgggttgtttgagtaaaagctcgttttctttaatgacatgaaaagtcgtttgtgcttctcccataccggcaataacatcaatgtattttcctcgcaaaaaatttttcacatcggttaaatcgccgagcgaaagtttttgatcacgtaaaacaagaattgagcctgttttaaacaaatatttcatattcggatcaactaataatttcccgtgtaaaattttttcgctattttctatcgcacttaattcagataacacgccaatttgtatatcttgcgaatagattttagtgtgtccagcatctaatcctgctacattaggaacaataacgttgatttccgtacctcttttagcagcttgaatattttcatataacgtatagtgtgcattattttcagctctaggactttctcttggagaatcaaatgcaacagccccctgtactattgcgtttaagctatctgcttgaatattgatacctgataagcctaaatttgcgttgattccggtaatgttccaaaaatgactgtctttttttacaaagtgagaataggctttgttgatgataacatcaacttcaacttttttctgatctttcgtgagccgataatcggcaatttgtcccacaggaatttttttaaagtaaaccgaggctccgctggataaagaacccagatcatctgccagtaaatgaattaacaaatcaccatcattaacttgtgttaatggagcttcggtttccgcaataaacgtattttccggcttaccatcgccgggttgtaatgtgatataattacctgaaactaaagcatcaattccggagattcccgccaaagaagcactaggctgcactaaccaaaattttgtattttccttgaggatgctttttgcctccggataaatatttgctaatacttccacttttttgagatcatcagtgaaatttactttttttactacgccaatttgtaacccttgatagcgaatttgtgtttttccggcaactaaaccggctccattcacaaaagttatcttaatactttccccttgctctttaataatctgaaagaacaaaagtgtacagatacataatgcaataaagggcagtaaccaaaaaggcgatatacgtttggtttgtttaatttgggctttcaattcttccattgtttctatttgattatctaattttttgtttgtcataaatattccaaagtaaacgactatcaaattgtgaagtcgacatcattgttaaaaataccgttgctccgaaataaaatgcggcaggacctactgaaaaatcaataagttgccctcttgttactaatgacatcatcagagcaagtacaaataagtcaagcatggaccaacgtcctacgaaatgtacaaaatggagcaagcgtatttgcaggtgaatcgaatgttgccatttaaaatgaatggagaacaaaagataacacataattaaaatcttactgaaaggaataaaaatactggcaacaaatacaacaaatgctacaaagtagcttcctaaattgataaaggtcagaacgccggacattaatgtgtcttctgttgctataccgttcacataaactatcgacattggaagcaaattagcaggaataatcattacgaccgcagccaataaggttgcccaagttcgctgtaaatagacttcatctgaaaaatcaaggcgtgatagacaacgtgggcaaatggggcgtcgttttctatccgtatgacaatgattgaaagtatgttcacaatacttgcacgcaataataggaagatttttttgttgtagcggagttttttggggataaaaatgccgccacaattcagcaggattgatttttataaataataatttggtcaaaagtgcggtaaaaataaatgcaattaaatagctattaatatgtaggcttgcatattcttgtactttgaacatggttacgcccaaagcaactaaataaacatcaaacatcacccagggttttagataatttaacgttaacagtaagtgacgaggtctgatgtctaatagctgtgataaacgaagtaaaataactaataaagcaaagcttataggcataaataccgcacatagaaaaatcataaatgcagtgtaaggatagccttgaattgccattttccatataccttgccaaacagacgcatttactggcgtaccaagcaggttgatggttaataatgggtatcctaaggcaaacggcattaaaatcaaaatagtcaatgcgatgattgcacaacgtttcaaatcccaactggaggtgttttgcagtactttgtgacaacgaggacaattcgctgattgatttttttgtaataagccaacagaaactaacgcattacaatcagtgcaacttataaggcagtatttagcttgtgataaattagtttttttctgcatgttgtcttattgatgaataataaagaaaggctattctaacctaatttttatcggaaatactatttttcattatagtcataagagaaaagtgcggtcatttttagtgaaagtttcgtttcatttaagtattaattgtttatttttttttgttttaagctaaaatgtggcgagtttttttatctaaaaagtcattaagacaggaatatataacatgactgaaattcaaaaattaacaaataacaaagaaattattgcttacttagcagaaaagttcccattatgtttttcattggaaggtgaagcgaaaccattgaaaattggtttatttcaggatttggctgaagcgttagcaaacgatgaaaaagtgagtaaaactcaattacgccaagccttgcgtcaatatacttctaactggcgttatttacatggttgtcgtgccggtgcggtacgtgtggatttaaatggtgaacctgccggtattttagaacaagagcatgttgagcatgccgcagctaagttagcagaagctaaagcgaaagttgctgaaagacgtgcggttgaaaaagcaaataatccaaaagcaaataaaaaacgctctgtacatcgttcagcgaataagtcagaaaataagaaatcagctggaaagaaattctccaaaccccgtcaagttgaacaaatttttgtcaacgttgatttagcaaatttacaaaaaggagatgtggtgagagttaaagcgggagataaaactactaaggctgagatattagaagtggttaaagagggtgcccgtgttgaattagagaatggattgatattaactgtaaatgcggatcgtttatttgcgtaattttataatacatggctaatttagtacctcatctcctctggtattattttcgtgtttaattattttaggaaagtgatctatgaaattacctcaacaacttcgttatttgctttgtttgctgtttggctttgttttaagtttaaattacgccgtcgcagttgaaccaaaactgaaactaacggatcttgttattccacagataacgcaagaaaatcaattagcaactaaaagaactgctgctcgtttggttcattcacattatcaagcagtagaactcaatgatgagttttctcagcggatttttgatcgttatttgaaagcacttgattttaatcgtaatacttttttgcaatctgatattgataatatgagagcaacgtatgcggataaaattgatgatgtgttaaatgagggaaacctggatattgcctttaatatgtatgagttattgatgaagcgtcgctatgagcgttatcgttatgctctatctttattggatgaagagcctgatttaaatggcaatgatcaaattgaaatagatcgggaaaaagcggattggccaaaaaatgaaactgaggcaaataagttatgggaacatcgagtcaaaaatgatgtgattaacttaaagttaaaaggtaaaaaatggcctgaaattcaaacgaggttagttaaacgttataatttagctattcagcatctaagtaaagtaaagtctgatgatattgtacaattgtatttgaatgcttttgcaagagagattgatccccataccagttatctggcacctcgcacagctaaaaatttcaatgaaaacatgaacttgtctcttgagggaataggtgcaactttacagtcagaagatggtgaaaccactataaaatcgcttgttcccggtgctccggcagatcgtagtaaaaagcttaaagccggtgataaaattattggagtcgggcaagcgacaggggaaattgaagatgtagtcggttggcgtattgatgatgttgttgataaaatcaaggggaagaaaggaacaaaagttcgtttagaaatagaaccagctaaaggtggaaaatctcaaattattacgttagtgcgagatcgtgttcgtttagaagatcaggctgctaaactaacagttgaaactgttgctggtaacaagatcgccgtgattaaaattccggggttttataatggcttaaccgaggatgtacgtaaattacttgctgaagttgaagctaaaaaagcggaagctttaatcattgatttacgtggaaatggtggcggttctttaccggaagctattgagttaaccggtttatttattactgacggtcctgtggttcaagtgcgggacgcacatcaacgtattcgtatatatgatgatcctgatacagaacaagtttattccggtcccttgcttattatgattgaccgatttagtgcatccgcatcggagattttttcagctgcgatgcaagattataatcgagccattattcttgggcaaaatacttttggcaaaggaacggttcagcaaagtagatcactgaactttgtatatgattcaaatagtatggctcctttgggtttactgcaatatactattcaaaagttttatagaattaacggtggcagtactcaattaaaaggagtcgctccggatattatttttccctcctctattgatgatgaagaatatggggaagaaaaagaagataatgcgttaccttgggataaaattccatcagcgtcatattctgaagtcggtaatgcacgcctgccggtagatatattgaatcagaaacatcttgaacgtattgcgaaagaccctgagtttattgcactggatgaagatttaaagattcgtgatgaaagaaaagaacgtaagtttttatcgttgaactttgctcaaagaaaagctgaaaatgataaagatgatgaaaaacgcttgaaagatcttaatgctcgtttcaaacgagaagggaaaaaaccactaaaagatcttgatgctttgccgaaagattatgaggatcctgatttttatttaaaagaagctcagaagattgcggtagatttaattgaatttaataaaaaaatggctgagtaaaataagatttaaaatatccgcacttttgaaaagtgcggtcttttttgttatctaaggaactaaaatgagaaaaattaaagttatcttattaatcttattattaggcactacgactcatatttatgcacaacaaaagtttaattctatagatgagattaataatattactttaagtaaatcacaattattgtttgaattagatttattggaacaacaactatccgaggaatatcagcatagattatatgaacaattacattctttgctcagaaatatagatttacaatttaaaactacaattggtcgtatttatgttgaaaatgactatgcattgctttgggaagataagcaagctgaaaaaatgtttttacgtgaatatgctgcaatggttgcaagcggagtctctgaaagagcggcaagattattgaatgatatttataaagcatctgaaataggagggttagtttatgatatgttgctgaccgacgcatttttggattatatgtattattcaaaaaatgcaaaaaattttgcacaacagtggttctactcagcaaatagctacaaagctcaattaccatcaaaacaagatattcaacgatggctatcatcaataaaacataatgaaaatttgatgttcatcgaacaattagctcaacataatgagcaatatgagaaaattataactcacctgagtaaattaatacctcaagatgacaagtcaatattatacaaattagcaattaatgctcagcgtttaaggattattcctgattttaacaatggtatttttgttaatattccaagttatcaattaaattattatagagatggagaattagttttaaactctaaagtcattgtcggtaaaaaagcacgtaaaacaccggtaatgtatagtaagctaagtaatattgttgttaatccaccttggatacctactcctcgtttaattaatgaagatatcgtgccaaagattaaacttgatccggattatgttgctcgtaatagttataccataagtgatagcaaggggcaggttatagatccttcttcaatagattggaatactataggcactaattttccctatcgaatccgccaagctccgggaggaagtgcattaggaaactataaatttaatatgcccagttcagatgcaatttatttacacgatacacccaatagaggattatttagcaaaaaaaatagagcattaagttcaggttgtgttcgtgtagaaaagtcagatcaactggcgacaattttattaacagaagccggttggacagaagaacgtaagcaaaacgtgcttaatagtaaaaaaaatacttcggagaatattcgctccgataatcctgtatatttatattatgttactacttgggttgaaaacgatgtcgtgaaaacattacctgatatttatgagtatgatcaagtacctcatttaacttatattaactggaatattattaaatggtatctaaattaaaatgtgagcagcaagaactaaatattatgtttgctgtcgaaagcaaatcatttagcactttataacgaaatattatatgaatgaaattaatcaaaatcgtcgcaaatggctatctttaggagggattattcttggtgcagccttgttacctcaaagtgttttagccgtattaccgaagccttctaaatctaaatttttatcttttagaaacatcaataccggagagagatttcgtggtgagttttttgccaataaaggtttttccagctctgatttgaaaaaaatagatcatttaatgcgagataaacgcaataatcaaattcataaaatggatcccaagttatttcataaatttgttcatattcaaaacaacttaggtttgcaaaattctgaaattcaaattatttgcgggtatcgttctccggcgagtaattccgccatgctacgtagtggtcgaggtgtcgcacgtaacagctatcatactcgtggacaagcaattgattttcgcattgagggggtttcattagcgaaacttcgtcaaacagcagaaaatttgaaaaatggcggtgttggttactatcctcgcagcaattttattcatgtggatacggggccagttcgtacttggcgaggtagctaaaatactaaacgtaatatagttgaccgcactttattcaaagtgcggttttattatttaaataaataaggaaatgatatgaatattgaaattgtgccggtaacggcatttcagcaaaattgttcaatcatttgggataataacaaaaatgcggctattattgatcccggtggtgaagcgacaaaattaattaaacgcattgaagaattaggcttaaatcttgaattgatcttactgacccatggacatattgatcatgtcgaagccgcactgaagttaaaacaatattttaatgtagaaatttggggttctaatgaaaaagatgattttttatttaatagcttaccacaacaatctgagcaatttggcttactttttgagactgaggtatttaaacctgatagatggttaaatcaggagtatgaaattgtccgtattggggaaatgaattttgaagtattgcatcttccggggcatacccccggtcatgtcggttttatcgaatatagtaaaaaaattgcttttaccggagatgttttgttccaaaatagtatcggaagaacagactttccaagaggaaatcatgctgaattaattcaatctattcgtgacaagttatggaagttagatgatgatatgattattattgcaggacatggtaattatacaaccataggaaaagagaaaaaatacaatccctatatccgctaaaagttaagatgcaaattatgttattgatttacacttaaaggacaattcactagaatagtcaacatttattaatttatcttgaattctataaaggtagcaaaatgattgatccaactttattacgcaataatctttctgaaattgcggaaaaattaaaagtaagacgaggctttattctcgacgtagataaattttcacaattagaagaacaacgtaaggctttacaaattaaaacggaaaatttacaagccgaacgtaactctcgctcaaaaacaattggtgcggcaaaagccagaggagaagatatttctactttattggcagaagttgatcatatgggagccgaattaaatactgtcaaagaagaattagcgaatgtattaacggaaattgagcaattggcattaacaattcccaatattcctgctgatgaagtacctttaggaaaagatgattctgataataaagaagtttttcgttggggaacaccaaaaaaatttgatttcgaagtgaaagatcatgttgccttaggggaaatattaggtgggctagattttgctgctggtgttaaattaagtggtgctcgttttgccgtaataaaagggcaaattgcaagaatgcatcgagccttggcacagtttatgctagatttacatactgagcaacatggctatacagaggcttatgtaccttatttagtcaatcatacaacactttatggaacggggcagttaccaaaatttggtgaggagttatttcatataaaacccctagaaaatgaacagacttatgcgttaatccctaccgccgaagtgcctgtaacaaacttagttcgagatgaaatcatcgatgaagtcgatttaccaataaaaatgaccgcacatacgccttgtttccgttctgaagcaggttcttacggtcgtgatactcgaggtttaatccgtatgcatcaatttgataaggttgaattagtacaaattgttgaaccggaaaaatcaatggaagcactggaagaattgacaaatcaggcagaaaaagtattacaacttttaaatttaccttatcgtaaagttttattgtgtacaggcgacatgggattcggagctactaaaacatatgatttggaagtgtggattccggcacaaaatacgtatcgtgagatttcttcttgctcaaatatgtgggatttccaagcacgtcgtatgcaagcccgttgtcgtgcaaaaggcgataaaaaaacacgcttagtacatactttaaatggatcgggactagctgttggccgcactttagttgccattcttgaaaattatcaaaatgcagatggctctattaccgtaccggaagtgttacgctcttatatgaatggaatagaaattattggtaaataatctgttgccgaaagataacaacgctccttttgggagcgttatctcatcaagccaaacctgtcataatcttactctcaaagaaatcataatctactaaaaaagcatcgtgtccataatctgaaggaaattcataataatttaaatcaacgccgctttgctccaataatgctttacttttatgtagatcggtcaatttaaacagctgatcagtggtaactgcgaccaaagtatagcgtgcttttatacgacttaatgcagccttaatgtccttatagttccaagccggatcatataaatctaaagcccgcaataaatgcacatagctattggcatcaaaacgttccaaaaattttttcccttgataagttaaataagattcaacttggaaataatctccccaatacagactttccgcttttttagctcgtccaaacgctttttctaattgaaaatcggtacgataggtcagcatacccaacattctcgcaatagataaccctttacttggaggcagtctgtcataataatctccattattaaaatgaggatcattaataatcgcttgacgcatcacatgattaaacccgattgcctccgcacttaaataaagtgacgaacaaagattaaccactctgctaacgcaatcaggataatcaatagcccattgtgtcgcttgcattcccccgaacgagccaccaatcacagcataaagttttgctatatccaatgtattcagcagttctcgctgaactttcaccatatcttgtacaataatatgcggaaactgactaccgtaaggtttatttgtatcaggattaatggacgacggacctgttgtccctttacagccgcccaatacattagaacaaataaaaaaatatttactcgtatcaagtgccaatccctcgcccataaaactctgccaccaaccattttgcgatttatcagcaaaataaggttcagcatcgccggtcaaagcatgacaaattaaaatgacattgctcttatctttatttaaagtaccataagtctgataagcaacttcaatattttttaattgcccacctcgtactaacatcaagggataatcggtaaaaagcgttaaagtttgtacagccatgtaaatttctcaaaaatcttaataaaaagcaccgcactttataaaagtaacccctgtaaactactcatactctgtttcattgtcaaggaatttttagccatctaaacatctagacagccaataaaatttacttgaaattacccgcttttttcattattttgtagcctccgaacgaggcagctataaaatgaacttagatttcacacaactttcttttccacaatggataataacactcgtcaagcgattactacattacagctttgctttcagcatttttacatttttttcccttattatcattgatcgcagcatagcttggtatgttcaggacagaatttatacaaaaattgaagaacttccctcccgcccttatggtattgtattaggcacagcgaaatactttagtaaaaataatcccaatctctactacaacaatcgcctgactgctactgttgagctttttaaacaagagaaaattgattatttattattgagtggtgataacagaacaatgcaatacaatgaacccataaccatgtttaaagatttgcgaaaaatggatattccagaagatgttatgtatatggattttgccggttttagaacgttagattccgtcattcgtgcagataaagtctttaaagcacagcccatgacaattattacccaacaatttcactgcgaacgagctttatttatcgcaaaattctatgatatcgatgctatctgctttgccgcaaaatcacctgctaactacttatctgtacgaatgagagaattatttgcaagagtaaaagcgattttagatattgtattagaaaaagagccttattttttgggaaatccagaaccgctcccgacgccaataactcaattatgatcttcgctaaataatctagcaagcttataaaaaagacaataaagttaaaaatcccatcagacaacatattattttccaaccattttctaccgcacttttggcaaaacatttattaatcacgatcaggtaaaaattttaaggttttacacagacttatatttgtcaagattgaaaaaagaaaaaaaacagaaaaattttaaaaaaaacttctagacttaatgtaaccatttgaaaaataatgaaatgttattttacaaccaattttatatgaagatatggaaaccctagattttacaaggtttaagcgaaataaatcttgaataatttacagagttatccacaggttatgtggatagtaatttgcatgaaaaaatttttactataataaaaaaatcctgttgacaagcatacaccagatcattatcatacgcacctctccttatgagaccatatttatggtatttttcctccttagttcagtcggtagaacggcggactgttaatccgtatgtcgctggttcaagtccagcaggaggagccagttttttcttttgggttgtttttatttgtctccttttataaaaactcaatttaccaaaagactttaagcccatttagatcttctccttgtatgggcttttattttttcttttctatattcaaatttctcgaaatttattttatactcgctactttcacacttcatttatatctcgtttaggttcaaatatgttattccctatactcgctattatttcaggtttaattattttagtttggagtgctgatcgttttattgacggtgctgcatcgctggctcgtttcctcggtatgtccgcattattgatcggcattatcattgttggttttggaacatctgcccctgaaatgatcgtttctgccctttccgctttaaatggaaatcccggacttgctttaggtaatgcttatggttcaaatattggtaatattgccctaattttaggtttaaccgctttaatcaaacctgttatagttaattcgctggttttaaaacaagaattacccattttaactttcgtcactttagtttctgcttacttaatttatgatgctgaaatttctcatttagatgcgattattttacttattatttttgctatatacatggcttggagtatttggcaaagcaaaagatcagcccaagacagttttgccgaagatgtaacgacagaattggaagaaaaaaaaaccatatcagtaaaattagcagtattttggatgattacgggattgattttactaatgggaagctcacaattattggtgtggggagcggttcaaattgcttctcaattaggtgtgagtgatttagtgatcggtcttactattgtagcgattggcacttcattacctgagttagcagcctcaatcatggcggctcgtaaaggtgaagtagatcttgcggttggtaatattattggttctaatttatttaataccttagctgtcgttggcatagctggcttaatttccccaattcaagtgagcaatgaaatatttactcgagatatgttagttatggggggattaacgctctcactgttctttttcggctatggatctcgtcaaaaaaatggctcgattaatcgtgttgaaggcggtttattgataacaagttatatcgtctatacttatttcctcattaccaccgcactttaaacaataaattaattgggagattaatttctcccaattaacaaagctcccccacgtatcggtaaagttgtgccatacattaaactcaaggcaaaaaatataatcatcagaccagcaagtatcctgactaggatatgccaaaacttcttatgtgttgaaaaataaaaatgccctaactgaaccgcacttttccgtgcatacaacacaattaatgcaaaacctgacagcattaatccaacacctaatgacatcgctacagtagccaacattccccaaacatacaaatccaacatatacgacaaaaataggataaatattgctccagaacaaggacgcattccaatagtgaaaataaccaaacattgtgattttaaactctgtgcttgctgtaactgttgctgattaggtaaatgctgatgcccacaagaacaattatccgtatgctcatgaaatcttgacaaattttgtaccgcactttgcatacctattttattggtaggtattgaagagagcgtgaattgcttgatttttagcgactgactattttttttcaaaaaagacttgctcccttgccaaatccattgcaatcccaaaataatcatcaagaaataagctccacgttctaaccaaagctgacttaatttaaaatagctcgaggataactgtaagatagccacaacaattaatgtcagggaaatcgccacaataccttgcattaaagaagcaaaaaaagttaatttcatactggtttttatctgggattgatgggttgccagataactaccaataataaactttccatgccccggacctaacgcatggagaacaccataaataaaactcaccacaattaatcccattcctgcataaacaggggcttgttttacttgatgcaggtaacttgaaagtaattgattaaattctctctgccaaattaaaacgtgtgaaaataaatatgggaacagataaataccacctaacgataaaaatacaagtaataatataagtttataggttctttttattgacattggataactactttttgtgcaaatataacgcctaacgagctgtcttcatcacgttggttacgatctaaagaggcagcatattctcgtaatttttgatcaacttgaggttcgacaacatttccttgacaatgttgcggaagtgacgaaaaatctaccgcacttttctccttgtctttatcgtaatacatagatacatagtaggttgaatcataagtagataattcaaaacggttattggataactcctgaggtttagctaataaaaaatcaaaaaaatataaaacttgtgcaccgttagattttaatccatagttttgaggaattgcagaatacttaattttatttcctttcttatcatacaaataactaaaataatgttcattaacaacattttggatcatatcatcaataaatttttgtaattctttttgatcatcttgcaaaaaagccaaatcatataaaaccgcagatgaacttgattcatctaaaatccattgcatagaaaaaccaactaatttttgcttgtcaataatgggttttgtctgcatttcaataaaagcgtgtgggtgagctaaactgtatataggcaaaaaaccaagaataatcccgaataaacgaatgaattgttgcatattcttccaatcaaataactaagtacgcattatgctatcacaatatagcgttgatttttatcttttcaaaaaaatcatgagaagttgagtttgcggaaattaagccccctaaagaacagagttttacggcaccgtcagataaaaaacttacggattatcacacataaagctaacaaaaatcagtaaaagtgcggtacaattcgcaagtttttcacttttcaaacgtggcttatgaactatcaaacatacattcctgatgaatatactatgtgtcaatttggtaaaaagttgatacatagtattgctcaaatcaaaagtaacaaaggaataaccctttatttacaaggtgatttaggagcaggaaaaactacgttaagtcggggaatgatccaaggtatagggcataccggtaatgttaaaagccctacttataccttagttgaagaatatcatcttggtgaaaaagatatttatcatttcgatctttaccgccttagcgatcctgaagaattggaatttatgggcattcgagattactttaatgaaagatccatttgcttaatcgaatgggcagaaaaagggcaaggcatattacctgagcctgatttaatcgttcatatcaattactttgatgatgcacgtagtattgaattacactctatatcagaacaaggccatttaattattcaacaattagtttaaaccatgaattacttacaacgcttgattttcattattttagcgattttcgcctttaatcatgcttttgctcacgtttggacaattgccatcgatcccggacatgggggaaaagaccccggtgctattggacgtcgtctcaatatctatgaaaaaaatgttaccctttccattgctcgtgaactaaagaaattgttagataaagatcctcactttcgtgccgtactcacacgagaaggcgattattatatttcagtctctaaacgctcggaaatcgcacgtaaacataaggcaaattatctcatctccattcatgccgattcatctgaatcaagtttgttacgtggtgcatcggtttgggttttatccaatcgccgagccaatagcgaaatgggacaatggctggaagatcatgaaaaacgttccgaattgttaggcggtgctggtgatgtcttagcttcacataaagaaaaatatctggataaaactgtattggatctgcaatttggacatagccagcgtgttagttatgaacttggttcagttgttttacgtcactttgctcgtatcgcaaaattaagtcgtagcacaccgcaacatgccagtttaggcgttttacgttcccctgatattccgtctattttggttgaagcaggttttctttccaatgcagaagaagaaaaaaaattaaatacccttgcctaccgtaaaaaattggcaaaagttatttatgatagtttagtagaatatcgcaaacgcaatttaaaagtagacctcaataccacaaagaatacccgccaaactaaaccaaagaccaacagtgcggtagataatacaaataaaacacccgttaaagacagcggtattcgtcataaagtaaaagcaggcgaaggattaacgagattagcaagaatctataaagtgaatattaaagatattatcagtttaaataaactcaatcgtaatcaactttggcttggtgaaataataaaaattcctgctaacaatgaaaatacaccaaaagagaaagcgaaagcgaaagagaaaaagaaagctaaagataaaaatgcaacattccatatagtgaaaaaaaatcaaacactctatgcaatttcacgtcaatacaacattcctgtgaaaactttgctcaaactcaatcccaaactaaaagatggcaaagtacaaacagggcaaaaaattaaattacgtgaataagggctaagcaaacgtatgacaattaaaattcttcctccacaactggctaaccaaatagcggcgggcgaagtggtagagcgtccggcttctgtcgtcaaagaactgattgaaaacagcttggatgcaggagcgacacacattcaaattgagattgaaaatggtggtgcaaatttaattcgtattcgtgacaacggcataggaattgcaaaagatgaactccatttagctcttgctcgccacgcaacaagcaagatcgccagccttgatgatcttgaaatgattttaagtttaggctttcgtggcgaagcactcgcaagtatcagttcagtttcccgtttaaccttaacctctcgtacagcacaacaaaatgaagcatggcaggtttatgcacaaggtcgagatatggaaaccagcatcacacccgcttctcatccgattggcacaacagttgaagtagcaaatttgttttttaatacgcctgccagacgcaaatttttacgtacagacaaaactgaatttgcacatattgatgaagtaatccgccgtatagcgttggcaaaacctcaagttgcttttacgttgacccataacaataaattaatacaccgctataaaagtgcggtaacaaatgagcaaaaaattaagcgcattgcgactatttgtggcaatgattttatgcaaaatgcgttacatattgattggaaacataatgatctacatctttccggctgggttatacaacctcagtttgctcgtcatcaaaatgacctcaattattgttatatcaatggcagaatggtgaaagataaagtgattactcatgctattcgtcaagcttattcagaatatctgagcaatgaaaaatatccggcatttgtattgtttattgatctcaatccgaatgaagtagatgtaaacgtacacccaaccaagcatgaagttcgctttcatcaagctcgtctaattcacgattttatttatcaaggcatgacaaatgcactcacctctgaacaaaccaatattccaatacagagtgaacaatccaatccaaccaaagttgccgaacctcaaggtatttggaacttgaccacgcataacaaaggtaatcgagcgactgccggcaaaaatatttttgcccagcaacctaaagattatgataaaaaatcatctcaatttaaaccgcactttgcagcaaattacagcgaagtaacgccaaagaaagcagtgcaaaaagcctatgcagaattactcgcaacacatgaagaaaaaactatcgcctcttctactctaccccatcaatttacacacaatacaacgcatatcagcgaacagaaaaatgttttacatgcacttgcattaattgaaaataaggcattgttattgcaacaaaaccaacaatatttcctcctttctattcaggcattgcagcatttcaatatccgcttacagttgcaacaaagtaatattgcacaacaaacattgcttattccgattttattgcgtttaaataaacaacaatatcaatcttggcaacagcaagctctattttttcaacaaagcggtttcgattttacagaaaattctgcacaacacagaataactctaaaccgtttacctatttgcttgcgtacacaaaatatacaaaaaataattttacagttattggatcaacctcatgaaaaatacactatttttcttaccgcactttgctcacacttggaatttccctcgctcagtactttctccgaagctgtaaatttactcacaaaaactgagcaacaattttcaacccaacatcaaccggaattccaatctttattagtcaaaatagactgggatcactatttagataaattgcaatgaataaaaaatcaactgctatctttttaatggggccaaccgcttccggcaaaaccgacctcgctatccaattacatcaagagcttcctgttgaagtcatcagtgtcgattcagctttaatttataaaggcatggacattggtacagcaaaacccaatgcacaagaattagcactaacacctcatcgtctaattgatattaaagatccaagtgaaaattattctgctgcagaatttcgtcatgacgcattacaagaaatgaaaaaaatcacgcaacaaggaaaaattccacttcttgttggcggtacaatgttgtattacaaagccttattggaaggactttcgccgcttccttcagcggatgaaaaagtgcggttggaaatagaacaaaaagcagaaaaatttggttgggcaacactacacaacgaattagccaaaatcgacccaatatcagcacaacgtataaatcccaacgacagccagcgaattaatcgtgcattggaggtcttctatttaacaggacaatctttaacagaattaaccgcacaaaaaggcgaagaaattccttatcacatcatacattttgctatcgcacctgaacgagctgttttgcaccaacgcattgaacaacgttttcataaaatgatcgaacaaggctttcaacaggaagtcgaaaaactttatcaacgctcggatctacaccctaatctaccctctattcgttgtgtcggttatcgacaaatgtgggaatatttacagggtaattatgataaagacgaaatgatatttagaggtatttgtgccacaagacaattagcaaaacgacaacttacttggttacgtggttggaaatcgcccatagaatggctagacagcctaaacccaaaaagtgcgaaagaaaaaatcataaaaaccataaaacataactgtaaataaagttcacaaaatcgtttttttctataaaaatttaggataaaatggctcgaatttttacttgacaaacaaaatagaatagaaaaaatgacagcctacagcctacagcctacagcctacagcctacagcccacagcctacagcctacagcctacagcctacagcctacagcctacagcctacagcctacagcctacagcctacagcctacagcctacagcctacagcctacagcctacagcctacagcctacagcctacagcctacnnnnnnnnnnnnnnnnnctacagcctacagcctacagcctacagcctacagcctacagcctacagcctacagcctacagcctacagcctacagcctacagcctacagcctacagcctacagcctacagcctacagcctacagccyacagcctagtatattgnctaaaatcaacctttcaagttaattttgagaggttggacatgttcaaacaayatcttaaaaatcacctatttcaacctcaacctttcggcgaarrtayyattcgcctttttttgttgtgtcttaaaaagcaaggcatcgccgatttatttatcaatctatctaaaaagtaacacgtttaatcaataaacaaccgtaaaaaagttaaaaaaatcaacaaaataaatcaataaaaaaacctaattttaaaagcttaaagagagtgaatttatgaacaaaatcttcaaaacmaaatacgatgtaacaacaggtcaaacgaaagttgtrtctgaattagcgaataaccgtcaagtggcgagccgtgttgaggcgtcggggcgtcagccgaagtgcggtgtgtttttaggcatgtttaaggtgttgccgttggcgttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatgtccgctattgctataggaactagtgcaacagctaacgctcaaaatagtgtagcgttcggaaatgaagctagcgtaagcatggaaaattcggtggcattagggaataaatcacatacaaaatatttctatcaaaatgataataacaaaaacactgccacgctcatcggaaacggcaaaaatgaggcgattgagttagccccttatgttccagagggttctagctataacttaacaaccgataaaacagcgggtattgtgtcggtaggttggacaaaggataaaagtagaaatagagaactgggcttaagacggattgtcggggtagcaccgggtgcgttggactctgacgtggcgacgattgggcaattaaaagccttagaatatgtaaaaagagaaggcttagtcgtttattatacgcaagataatggaaaaatatataaattagttaaaggaacagatggcaacttctataaggtagatacaaaatatggaacaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcgggcatttagccgatggagagatttccaacaaatccgatcaagcgattactggggcacaactttatgatcttaaaggtaagttggggttgnnnnnnnnnnnnnnnnnnnnnnnnnnnnnnnnnnnnnnnnnnnnnnnnnnnnnnnnnnnnnnnnnnnnnnnnnnnnnncaaaatacttttaaaggggcaatagaggatcttattaaagctgtaaataaaggttataagtttagcgatggaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttaccatcggtttaaccgacaccccagaatttacgagtgtaaaacttacaggcacacctacagagaacactcacgccgttaataaaaaatacgttgatgacaaactcaaagacgtggcttcaaatatccactttatgtcagtacatacaccgaccacaacaccaaaaacaaaaggcaattacaacaacgacggtgcaaaagttgagggggcgattgcgattggtgtggacgcaagtgccgcttctgaaaactccatcgctatgggtaaaggctcgaaaattgaggcggaaatatcgaacgccgtcgctatcggggcgaataatcatctcagagggaagaataaaggtcaagataagcatacggtggctattggttcagacaatatcatcaccggacgaaaaatcgtgaatttaggttcggggaataagataggtaatactgatgataattatmaamatgttaaaggagcaggtgcggtcagcatacgagtgatcggggacgataataaggttcatggagtatggaatacggtcatcggcgaagggaataaatttacagattcctcagtctatgttcatttgatgggtgataaaaataccgtcacagattctaaaaatgccatcatattaggcgataacaatattgtctcaaaattagcaaactctatcatcattggtaaaaacataactgctaaatctaatgttaaaaacgataataatttaatcgtcatgggtaaccaagcccaagcaacaaatgcgaataacagtgttgtgatcggtgcgtctgcaaaatctacagcgacaagtgcggtcgtgattggacaaggtgccgaatccaaagcccaaagtgcggtagttttaggtaaaggggcgagtgttcaagccaacgccaccggtgcagtagcgattggtgaaggggcgtctgtatctacaaatgctggtaattcgattgcgttagggaaaggatcgcaagcgacggctaaagcgaatgcaaaggcaaatgctactgtagagggcgtgaattttgcctttgcaggtgggactggaaataataagacagtattaagcataggtaaagctggaacagagcgtgtcattaaacacgtggcagcgggcgaagtgagcaaaacctcaacagatgctattaacggaagtcaattgttcagtgtgacaacggaatttgcaaaactggcaaaagatgtccttggggcggagttaggcacaactggtcaattcaaaaaatcagaatttaagacattaaaagccacaagtacgtctacggataccgcacaaaacaaaacatttagagaagcgattaatgcgaatatcgatcaaattaataaaggcttggtatttagcgacggcacaaaggatggcacaagacagctgggcgaaaagatcaccatacaagccggcaatattgacagcggtgattttgtcagtgacaacataaagacgaattacggtacggaacaaggaaaattcctgattgggattaaaaaagatccacgttttgaaaaagtcacagtaactaaagatgttgaagacacaagtcctgaaatgaccttaaccacgaaaaaatatgtggacggaaaacttgccaatgtcgccgctaaatttaccgtcaagggcgatactaacggaacagacggcaaagggtatgaattaaataaagacaatacggaattgaatattaatggagatgctaaaaacatcaccacagaggtggataaaaccgctaaaaaattaacagtatcgcttaatagtgctttaacaggcattacatcgatcggaaaagacgagagtaacaaaatcacgtttaatggtggtacaactatcacagccggcggtgcagggttaactttagcgaatgagggtgacaaagttaaaatctcaaatgtggctgatggtacaactgctaatgatgcggtgaataaaagccaattggatacaaaacaagataaattgacaggtactatcaccgcaaataatgggctacaaattacatcgggagatggtaaaaatactgtcgctagtaacatcactttaggcttagaaactggcttaaaagacaaaatcgacaatgccttaagtaaaaccgaagcagggaatacctatgcgaaagtggatgcgtcgaatataaacaatggtaatcaaacagcatggagaaataaactagacgtctattctaaattggaaacaacgaatgaaatcgccaaagcgaaagaaacagtcacaaatggtgcaggaattacggttacagaaacggctgctggaaatggagctaaaacatttaaggttgcattagaaaatagttataaaacaaaaatagacaatataggtaccggaactgtatcagataaaaatgacaaaaccgtaacgggtggcaaagtacacgaagctattgaggcggcaaaaactgacataaaaggtaaactgtatgcaaacacagcaacatttggcttaaaaggtaatgatagtcaaaaagtgaccaaaaaattggataacactatcgaaatcaaaggcactaacacggctagaactagcggcacaaatatctatgtctcgaaagccgatgaaaacggtctaaaaatcgaactgggtgaaaccttaaaaggtattacgtcgattactaagggcgataataagtctaaaatcgaatttaaagatgacagtatcgatttaacgccagttgatggtaaaactgtcactatcactaaagagggtaaaatcagcggcttgacagatggtcaaattgagaacgcctcaaaagacgtggtcacaggaaatcaattgcatgatctagcgggtaaattaggcgttagtgtggataaaaattctaaaaccggttttaccgcaccgttgtttgtcgccgtcaattatcaagggcaaacagcaactaacggaaaaactacctttaaagaagcaatcgatgatttgatcgtggctgtgaataaagggcttgtcattggcgacggtactgcaactggcacgcttcaactgggcgataccttgcagattaaagcggggaatatcgataaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgaaagaatatgtggatgcgaaattagccactaaagcagggacatttaaagtgagttcggataaaggtgacacaaacaatatcaccggcactttatctgtcaaaggtaaagaagatgatgctaatggcaaacatcaaaatattaaaacagaagcgacaggatcgaatttaacgatagcacttaatagcgacttaaaaggcatatcgactattggaaaagatgataaggctaagattagctttaataaagatactgctaaaaatgagatcgagtttagtttgggagataacacgaaatataaattcgatgagaatggattagacttaggaggtaaaaaaatcaccgcacttgcgagcggtttagggttgaaagatgctgatactggaaacggaaatgccgacattattaaaaaagtcctcgagggaactcttgataatggcagtaacattaaatccactaacgccgtcaatgtaaaagacctttccaaagtcgccgaagcccttgtggaaaaaggactttcatttgaggggaatgatggaagtagtaataaagttactcgcaaactcggtgagacgttgaaaattgtgggcaaaggaagtggtgctaactcaataacaaccactgaaaataatattaaagtgtctaaaaatacagcaaacgatggactggaaattggcttgtctgatactttaataggtattaaatctgttggtaatggcgataatgcgaaaattactttaagcggaagtaatggaagcaaggacaaaattaccttcaaagcaggtagttcagaggttaccctagccgatggtaaatttagcggtgtttctgaaattaataaagaagcggataaaggagcgttgaaactnnnnnnnnnnnnnnnnnnnnnnnnnnnnnnnnnnnnnnnnnnnnnnnnnnnnnnnnnnnnnnnnnnnnnnnnnnnnnnnnnnnaagaggataaaggagcgttgaaactcactgaaaacactgccactttagaaagtgccaaagacnnnnnnnnnnnnnnnnnnnnnnnnnnnnnnnnnnnnttaagtgtgggtaaagatgccggaagtattaaagtyrycaatrrwgsggayaasaaaatcgagttaagtccggaaaacggctcaactgttacgttgaaaaaagacacgacaaatggcggagtgcaagccaccggcttatctaccatcggtaaagatgakartaacgccttagtgtttaaaaacggtacgagtggcacgaacacggcagagttaaaagtgggtggtgcgactttgaccttcacgcctactggaaatggaataagtggaactaaccaaacagtgaaaatctctaatgttgcgactggtaagatagaaagtggttcatcagaagccatcactggcggacaactttccgatttagcaagtaaattgggggttgaggttgacagtgggaaaactgcgtttacagcnnnnnnnnnnnnnnnnnnnnnnnnnnnnnnnnnnnnnnnnnnnnnnnnnnnnnnnnnnnnnnnnnnnacaacctttaaaggagcgattacacagttaatcaccgcagttaatggtggattgacattcaaggggaatgatacttccccaacttcaaccacattacaattaggtggaacattgaccattgatagttcgagtgctggtagtgaaaaagacattacagcaaaactggaaccgtctaatggtagtgatcctaaagataacggtaaattaacgctgacgttaaataaagcgacatctgtagatgagaatagtgaaaaagtcgttacytctaargcggtagcracagcgttgaaaaactatacggaaacatcgaaattaggtgatacgtatttgaaaatagacgggtcgaatattggnnnnnnnnnnnnnnnnnnnnnnnnnnnnnnnnnnnnnnnnnnnnnnnnnnnnnnnnnnnnnnnnnnnnnnnnnnnnnnnnnngaattggtacaagctaaagctttaatcagctatctaaaaggtacaggtcaaaaatccgttaaagtatccgataatccggaaactaaggctgaaggggactattctattgcgattggcgataaagcagtggcaaaaaatgaaagtgcaattgctatcggctatggtgctaatgctaaaaatagaaacgcactttctataggcagagatagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgaacacacttatgtcttgggttcaagtgtcacgacagatgacaaggtaaaaaatgctgttattttaggtaatagatcaacaggtgagaaagatgccgtatctgtgggtagtgatacgcaacaaagacgaattgtttatgttgctgatccaacgagtaaatacgatgcggtgaataaaaactatgttgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacgcatgcagttaatgtaggagatttagctaaaatttctaaggaaatagttgaaaaagggtataaatataacgctgatattccgtcaggtaatagcaatgataccagcataaaactaggctcaactatatctattgttaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaaaatcgaaatcggctttaaagacgcaccgacatttagcaaagtgacnnnnnnnnnnnnnnnnnnnnnnnnnnnnnnnnnnnnnnnnnnnnnnnnnnnnnnnnnnaacgatttgattaccaaatcctaccttgaggsggcrttaarmractttaagtttaatgtggaatatggtgataagaargtccaaatcggtcgtggcgatacsttgaartttrmwgmyggtttgaatattaaagtagagttagctcaaaatggtactacacaaccaagtgcggttggttctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaagcacaactccgtcaaatggtgcaggtacaaatggcggaaatggtacaagcagtacagcttcgtcaggagctactccaagtacgacgacagccggaacagcaagcagtacaacatcgaacaccactgcggtggtgacgattggtacgactgaggacttgacaggcttgaaatctgccgagtttaacggcgataacggtaacacgactaacattaccggcaatgaaattgtgttgaaagatcaggcaggtaacgctcatacacaaacggcgacatcgcaaatcatcacggataatacagatcccgataaggaaaaagcggttgtgacaacggctgagggcgtgacaatgtctgtggtcagcgatgatcaggttctggtcaatgatcaaacagcagaagcgaatgttttaagcaatggcaagcacaccaccgaggtgaaagccggcgaggttgctattaaggataaggccggtcaggaaatcgtgagcttgaaagtggcagagggtgaaaacggtcaagatggcaagggagctacgctggcgtttgctaaaggcactgacggtaaatcgggcactggcgtaatcacgggcttgaaagacctagatgccacggctgacggttcaagtgcggygaataaaaactatgtggatgaraaagtgtcagatttggayagcaatcgtccgtttgayttctatrttaaagarggaragarmkawaycaaagtyrtkaaaggacgwgatggtaagttctayrakcctraagayttrraaggggcgaagtatgatgcagaaagtaaaaaatatacttctcaagatggacaagaagttacaccagaatcggataaagtcattattcgtgccgaaccgactgccgcacctatcgggatgaataacgtagcgagtggtttgggactggcagatcctgaaactgatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagggtgaggataaaacgaaacttcaaactcaattggaggaaaacaagaaacagcttgaaaaagctaaagaagagctagggaaagcaaaaactgctttaaccgaggctcagacagaattaacagaagccaataaagagtatgagaaaaaytacggrggctatgaaaaagttgcwgasttagtgaaacctgatagcmaaryrgatttaaccaacgtagcmacmatygntganntgcaagcggtagcgaaatcgggcatgaagttcaagggcaatgatggtgttgaagtgcgtaaacaactcagcgaaacmctatccatcacaggtgaagaaaatgcaagtgacgagaagtttaacagcgacmkcaccgccgccggcaatatcaaagtggaaatgkcmcaagayggcaawggcttagaagtkaaattgtctgaccagttgaagaacatgacttckttygaracwcgtgaaatcaatggyaaraaatcggtgttgaacagcaacggtttacaagcgagcagtccagacagcgaaacttttgtaaatgcacagggtacccgtattacgggcaaaggaaatcatgccggtcaatcrgcaagttayaccctcgatggcgtggcgatcacaggtaagaacggaagcgtgcagttgaatacgaccgctctttcctttgcrrycackcragaccmakccggtaracctgtcggtacaggggttatccgaggtctgaaagacttggatgcccatgctaccggygatatggcrryraayaaaaactatgtggacgaaaaagtgggtgctgccgtcaatcgcttggataatgtcatcagtaccaacaaccgaaccttacaggcaggtattgccggtgcgaatgcggcggcggcattgcctacagtaacgatgccgggtaaatcgaccattgcgttgtccgcagggacttacaaaggcagaaatgcggtagcgataggctattcacgtctaagcgataatggtaagataacgctgaaattacagggcaacagcaactctgccggcgatttcggcggtggcgtgggtgttggctggacatggtagtctagtttaaccgctataaaaaagcagtgagtaatcactgctttttttatgataaaagtttcaccgctctttttagtttttaacgttcgacaaaatcgaaaagaaaatcctattaaattaattacccttgataatgtccgacgcccagctcgtcttctttacgagtgcggttaataacgacttgcggagattgaacaatacgtaaccccatttcatcttcggtacgaactacctcacctcgtagagaattggtatagacatcagtaattttaatatctacaaacttaccgatcatgttaggcgttcctgcaaaattaactatacgatttgtttccgtacgacctgttaattccataatatcttttttcgatggaccttcaaccaatacacgttgctctgtccctaacattgctcgactaaattgtgctgcttgattgttaatgcgttgttgtagcaaatataggcgttgttttttctcttcttccgttacatcatcaggcatatctgctgctggcgttccgggacgagcagaataaataaagctaaagctcatatcaaaattcacttgagcaattaaattcatcgtgtcttcaaaatcctgatccgtttcccccggaaacccaacaataaaatctgaactaatctgaatattcggccgcacttttttcaatttgcgaataattgatttatattcaagtgcggtatgatttcgcttcattaaattcaatacacgatctgaaccgctttgcacgggtaaatgtaagaaactcaccaattcaggcgtatccgcatatacatcaataatatcatcagtaaattcaattgggtggctggtggtaaaacgtaatcgatcaattccatcaatagaagcgactaaacgtaataactcagcaaatgaacaaataccgccatcatgtgttggtccacgataagcgttcacattctgccccaataaattgacttcacgcaccccttgctctgcaagttgtgcaatttcgaataagacatcatctacgggacgacttacctcttcacctcgagtataaggcactacacagaatgaacaatatttattacagccctccatgatagaaacgaacgctgtcggtccttccgctctcggttccggtaggcgatcaaatttctcaatttcaggaaaacttacatcaaccaccgcactttttccaccacgaatttgattaatcatttcaggtaggcgatgcaatgtttgtggtccaaatacaatatcaacataaggtgcacgtgaacgaatatgctccccttcctgtgaagccacacaaccgcccacaccgattaccaagctcggattttgtttctttaattctttccaacgacctaactgatgaaacactttttcttgtgctttttcacgaatagaacaggtatttaatagcaatacgtctgcttcttccggtacatcagtcagttctaaaccatgggtatttaaaagcaaatctgccattttcgaactatcatattcgttcatttggcagccccaagttttaatatgtaatttttgtgtcatgtcagtttttaaaattaatatctaagtaaaaaatcagtcggtcattttaccgagttgttgtagctgttgccagctaaaaatcagattttattttttaaatttaaccaataacgctaaaatagcgaaaattagtctgtggagaaaacacgtatgcaaaaagatattattgttgttggtggtggtatgattggtgcggcttgtgcgacaggattagctcaattgggattacaaattcacgtcattgaacatcattctctacctgaatttgattcgacatcggagtatgacattcgcatttctgcaattagtgctgcatcagttaatttattgaaaaccctaaaggcatggcagcatatcgaaaaaatgcgtattttcccttatcgaggactggaaacttgggaaattgaaggttttgcaacccaatttcactgccaagatttacagttagcggaacttggatttatggtagaaaataatcttattcaactaggattatggcagacattttcttcctaccataatattactaccaacgtggaaaatgcgattaaaaatgttgaaaagtgcggtaaaaattggcgtatttttttatccaatggagaaagttatcaagcacctctcatcattgcagctgacggtgccaattcacaattacgccaaattgcaggcataggtttgacaggctggcaatatcgacaagattgcatgctcattttagtgaatgtagaacaagatcaacaacatattacttggcaacaattttatccctccggacctagagccttgttaccattacaaaataagcaagcctgtttagtttggtatgacagcccacaaaaaatacgtgaattaaaacagctgtcaaatgaaaaacttgcagaagaaattcatcaagcatttccccctagactgggcaaaataaacgtacaaaaatttgcgacttttgcactaacacgtcgtcatgcacaagattatttcaaacaaggtattgttttagttggcgatgccgctcacacgattaatcctcttgccggacaaggtgtcaatttaggttttaaagacgtcaaagtcctgcttagtgtaattgaaagtgcggtaaaaaataatgaagatttttcagcggatcatgttttacaacgttatcaaaaccgacggaagcctgataatttactgatgcaatcgggtatggatctgttttataaagccttcaaagaagatagcatgccattaaaaatagctcgtaacttggcattactgggtgcaaacaaaataacgcctcttaaaaaacaagctttgaaatacgcacttggtttgtaaaaaatcacctaaaaatgaaatcatcactttcaattatgagctaatcgctatatcattagccattcaaaactaagggcgcttgcaattttattgtgggctttttatttctactcaatacctgaacaaacgcaggttcattagggagaaaaccaaagctagtggaaaatacagttcaaaacaagcctattattgagcttcgttctcttactaagtcttatgatacaaaaaccattatcaataacttcaatttaactattaataacggtgaatttttaacaattctaggtccgtcaggttgcggtaaaacaacagtgttacgtttgattgccggttttgaagagttaaatgaaggtcgtattattcttgatggtgaagatgtgacggatataccggcagagcgtcgtcacataaacaccgtattccaaagttatgccctgttcccacatatgacgatttttgaaaatgtggcctttggtttacgcatgcaaaaagtaccgaatgcagacattaaacctcgtgtaatggaagcattacgcatggtgcgtctagaagaaatggcggatcgtaagccaactcagctttccggcggtcaacaacaacgtgtcgccattgcaagagcggtagtaaataaacctaaagttttattgcttgatgaatctttatccgctcttgattataaattacgtaaagaaatgcaaaatgagttgaaagcattgcaacgtcagttgggaattacctttattttcgttactcacgatcaggaagaggcattaactatgtcagatcgtattatcgtaatgaacaaaggcactatccaacaagatggttcaccacgtgatatttacgaggatcctaaaaatctatttgtggcaaaatttatcggtgaaatcaatatttttgatgcgatagttattgagcgtacagacgaaaaaactgttaaagccaatgtagaaggtcgtgtttgcgatattcatacagagttgactgtccaaccaaatcagaaattaaaaatcttgttacgtccggaagatattataattgaagaacttgatgaaaatgaaagttccaaagcaattattggacatgttgttgatcgtagctataaaggcatgacattagagtcaagcatcattcttgatcataataaaatgaaagtattggtgagtgaattctttaatgaagatgatccgcatatcgatcattcagtgggtcaaaaagtggcactaacgtggcatgaaggctgggaggttgtactggacgatgaagatgaacagtaataaatttcaaaacttaactgttagtgtcattttcggctggttactcttctttgttttagtaccaaacctgctagtcttaacagttagttttctatcaaaagatagcagtaatttttatgctttgccttttagcttggaaagttacgcaaacttagttgactcacattacgccaaagtaatgtggaattcactccgtatgtctgcgattgcaactgttatctgtttacttgtaggttatccttttgcatttttcattgccaaaataaaaccctcataccgtccatttttgctattcctcgttgttttacctttttggacgaattcgttaattcgtatttacggaatgaaaatctttcttggtatgaaaggtattttaaacaataccctaattgcaatcggtattattgacacaccaattcgtatcttgaataccgaaactgcggtaatcattggattagtttacatcttactgccttttatgattttaccgctttacgctgccattgaaaaactggatcttcgtttattggaagctgcaaaggatttgggagcaaattcatttcaacgttttattagaatcattattccattaacaatgccgggaattatcgcaggttgtttgttagttctattacccgcaatgggaatgttctatgtgtcagatttgcttggcggagcgaaagcagccctagtaggtaatgaaatttacgtccaattcttaaaaataagaaactggcctatgggttcagcaattagtatagcacttactctactaatggctttattaatttttatttactataaaacaagtaaattattaaataaaaaaatggagttggaataatgagtcgtttactacgtaatatctttttgtttgtggtatacgcttatctgtatatcccgattattattctaatcagtaattcatttaacaatgatcgtttcggtaatacttggaaaggtttcggtttccaatggtatgagcgtttattcaacaacgatactctcattcaagccgctattcattccatcactattgcattttttgcagcatcattagcaacaattattgggacattaactgctatcgcactttatcgttatcgcttccgtggtaaacaagcgataagcggaatgttgtttattgtgatgatgtcgcctgatattgttatggcggtatccctacttgcattatttatgatggtgggtatatctctaggattttggtcattgcttttagcacatgttacattctgtttaccttatgttgtagtcagtgttttctctcgtctaaaaggttttgataacaaaatgttggaagcggcaaaagatttaggtgccggtgaagtaacaatattacgcaagatcattttaccgttagcgttgcctgccattgtttcaggttggctacttagctttaccatttcattagatgatgtagttgtgtcctcatttgtcagtggtgtaagttatgaaattttaccattaaagattttctccttagtgaaaaccggggtaacccctgaagtcaatgcactggcaacactgatgattattttctctttaatcttggtaatactcagtcaacttgttgccaaaaaagggaaataataatattccaaaactgtgaaataatatttcacaaatgatcctatatcacataaaataacacgccctactttcggtaaggcgtttttattccttcaacaccgaagtatattccgcatgttaaaagtgcggtcgttttttactcttatattggagaacaatagaaatgaaaaaattttcaggtcttttcacactgggaatgatcgctgtagctctagcagcttgtaatgataaagatactcaaaaagcagagactcaagcacctgctgcttctgcaggtgatactgtttatctttatacttggaccgaatatgttcctgatggattattagaaggcttcactcaagaaacaggcattaaagtcaaccgttcaagtctagaatctaacgaaacaatgtatgcaaaaattaaaactcaaggtgccgccggcggttatgatgttattgctccatcaaactactttgtttcaaaaatggctcgtgaaggtatgctaatggaattagaccacagcaaattacctgtcatcaaagaattaaacccagattggttagacaaaccttacgataaaggtaacaaatactctttacctcaattgttaggagcaccgggcattgcatttaatacaaatgaatataaaggttctgacttcacatcgtgggctgatttatggaaacctgaatttgccggtaaagttcaattattggatgacgcacgagaagtattcaatatcgcattgttaaaattaggacaggatccaaatacacaagatcctaaaattatcgaacaagcgtatgaagagttattaaaattacgtccaaacgtactatctttcaactcagataaccctgctaattcttttatttcaggggaagtgagtattggtcaattatggaacggttctgtacgtatcgctaaaaaagaaaaagcacctttagatatggtattcccgaaagaggggcctgttctttgggttgatacgttagccattccatcaacatctaaaaatccggatgctgcacataagttaattaactacatgttaggtgcaaaaacagcagcacaactcaccttggaaattggttatccaacctctaatatcaaggcgttagaattgcttccggctgaaattactcaagatccggcaatctaccctacaactgaagttttacaaaacagttactggcaagatgacgtcggtgatgcagttcagtattacgaagaattctatcaaaaattaaaagcggcaaaataatctttgcacacaaaagaaatgctcccattggagcatttctgttttgaaaataagcttaagctaaattcccaactaaatttttcacaaattccaaccgctctttatgtgacgtcaatgacttactaaacctaaacttagtcggtccgtcaaatttaaatacagtaggctgagactgaattaattgcacaaatttcatcggatcaagttctgcattttcagaaaactcaataaatcccccattaattgtgctatcaattttgacaatttttaaggtttttgccagcaaacgcaactcagcaatttgcattaaattcttacctgcctccggtaataagccaaaacgatcaatcaactctactttcaattcatctaactctgcctgattttccgctccggcaatccgtttataaaaagataatctcatattcacatcaccaagatattcttccggtaataatgcgggtacacgtaaatcaatctctacttgctgttgtgttaaagtatccaaagaaggttctcgcccttcttttaatgcagcaacagcattttccaataattccatataaagcgaaaaaccgatactttcaatttgaccgctttgctcatttccgagcaattcaccggctcccctaatttctaaatcatgggtagccaaaataaatccggcacctaaattatctaaactttccagtgcctctaaacgcttaacggcatctttggtcattgcttttggatgaggtgtcaacaaataagcatatgcctgatgatgagaacgtccaactcttcctctcagctgatgtaattgggctaatccaaaattatccgcccgttcaataataatcgtgttagccgttgggacatcaatccctgtttcaataatagtagagcaaaccagtacattaaaacgctgatgataaaaatcggacattacacgctccaactctctttctcgcatttgcccatgcccaacaaccactctcgcttccggtacaagtgcggtcagtttttctgcacaattttcaatacttgccacatcattatgtaaataataaacctgtcctccccgtaaaatttcacgcaacacggcttctcgaataatcaaatcgtctacctgtcttacaaaggtctttatgctcaatcgccgagctggcggtgtggaaataattgataaatcacggatgccactcatcgccatatttaatgttcgaggaataggtgttgccgttagggttaaaatatcaatattggttcgtagctgtttgattttctctttttggctcactccgaaacgatgttcttcatcaataatgagcaaaccgagatcgctgaattttacttctgactgaattaatttatgcgtaccgattaaaatatcaattttaccttcattcaagtgttgtaaaatttgtttctgctcttttgccgttctaaaacgtgacaacatttcgacattaaccggcagattggcaaatcgatctttaaaattttcataatgttgctgtgccaataaagtcgtaggaaccaaaaccgctacttgtttatggttcatcacggctaaaaatgccgctctcattgccacttccgttttaccaaaccccacatcaccacaaactaaacgatccatagctttttcttggcacatatcagaaataaccgcattaattgccattttttgatcgggtgtttcttcaaaaggaaacgtggcagcaaattgtttaaattcttctttatcatattgaaatgcaaagccttttttaacttcacgttgagcataaacatccagcagttcagcagcaacatcacgaattttttctatcgctttatgtcgagcctttgcccaactatcattaccaagtttatgtaaaggtgcattttcatcagatccgccaacatagcgactaattaaatgcaaagaggtaacgggtacataaagttttgaattattcgcatattccaataataaaaactcagctttaattccaccattttctaaactcaccaatccaccatagcgtccaacaccatgatctaaatgcacaacaggttgtcctatttttaattcggcaagattgcgaatgagtatatcgggattggcaactctacgtttattacgctcacgttgttgcactcgctctcccaataattcagtttcacaaataatggcaaccttatcctcattatcaataataaatccatgttctaaactactgatgagcaggcttttagctggcttatctttttcacccaaatcctgaatttgcgttggtttgagctttaaaggtaagagtaaatccaataatgtttcccgacgcccttctgtttctactgaaaaaataacagttccgtcaaattcctcaataaactgacgcaatttttgtaaaggttctttttgttgtacttgaacggttaattccggcaacggctgcacaggtaaatttttttgacgaacagaagtgcggtccaattttttactttttaaactcaatcttggataattttttaactgccgattaacttcatcaatgcgtaaccacaatttttctggcatcagtaacggacgcatcggatcaacacgacggctttcataacgttgctcaatatcctgataaaagcgttccgcttgcggcataatttgttcaaaatccacaaacaatgtattttcaggtatgtaatcaaacaacgtcgccatttgattaaaaaagagcggttgccaatattcgattccggaaactagagttcctttactgatttgttgataaatatgttcaggatctcgtctaatttccgcaaaagtttctctaaattgactacgaaaaaagtcaataccttttctatctgttgggaactcttgtgcaggtaataaattaatacgttgaatttcctctaatgtacgctgcgtatctacatcaaaagtacgaatactatcaatttcatcatcaaaaaaatccaatcgaaaaggcaccgcacttcccatcggaaataaatccaataaagcacctcgtactgcaaattcgccatgttccagtacttgttcgactgctcgataaccggcattttccaactgtaaacgaaatctttcgatatttaatcgatcacctcgttttatcaataatacattgtgttgtaaaaattctgccggacaaactcgttgcattacagtcgtaattggtgcaataaagatacctttgttgctatgttgcaactgaaacaaggcacttaagcgagctgaaataatttcttgatgtggcgaaaaattatcgtagggtaaagtttcccaatcaggaaaaaatgtaacaggttgttgagtgaattcagttaaaaatttttctaaacagaccgcacttttaacatcaggggtcataacaaaaatcaacccatcatatcgccgtacaatttctgcaatcacaagactatcagccccctgtaatacattacctagaagtttatgctcattgggctgggtaggtatgtcaaaattaaaatacatcatattcaaatggatttatgttgaaaagttgccatgtaatttgcactgacatcttgatttaaccaaaattttccggttaaaagattgtaatgataaccacaaatatttttacagactaaatttgcttggtcagtccaatgcagtaactcagccggtttgataaatttatcgtaatcatgtgttcctttcgttaacattttaagtatgtattctgcacctaaaaccactaatgcccatgctttaaatgtgcgattaatagtcgaaaaaaataagacaccattcggttttaataaagctcggcaagactgaatgatggataaggggtcaggaacatgctccagcatttccatacaagtaatcacatcaaatttttcagcgtaaagtgcggtttgtttttgtaaaaattcttcaacggtaatttgctgataatctatgaccagtccttgttccttggcatgtaaacgagcgacttcaagaggagcaacggtcatatcaattcctgttactattgccccttgctttgccatagcctcagacaaaataccgccaccacaccccacatcaagcacttttttttccgctagtccgttagcttgctgttggatatattgtaatcgtgtcggattaagttgatgaataggtttaaaatctccattcggatcccaccaactttttgccattttttcaaatttttctaattcttgcggatcaagattttgcatttttatcagtccgtatagcagtaaaaaacaattacgctattattccttaactgcgttaaaaattcactacaaaatttcgagaaaatcagaagttatgctataatctcgccaatttttcgtacctaattaggaaatctcaatgactgattttacccccaacgttactcctgtgagtatagaagaagagcttaaatcttcgtatcttgattatgcgatgtctgtaattgtcgggcgagctttgcctgatgtacgtgacggtttaaaaccggtgcatcggcgtgtgcttttttctatggatcaaagtagcaatacttacaataaagcctacgtaaaatctgctcgtgttgtaggggacgttatcggtaaatatcatcctcacggtgatagtgcggtgtacgatactattgttcgtatggcacaacctttctcgttacgctatatgttggtggatggtcaaggtaacttcggttcggtagatggtgatgcaccggctgcaatgcgttacaccgaagtgcgtatgcaaaaaatcacccaagaattactcaccgacttagataaagaaacagtggatttttcgccaaactatgatggaaaagaaatgatccctgatgtcttgccaaccaaaattccaacattattggtcaatggttcttctggtatcgctgtgggtatggcaaccaatattccgccacataatttaaatgaagtattggatggctgtttagcctatgtggataacgaagaaatcagcattgatgaactaatgcagtatattcctggtcctgacttccctactgccgctttaatcaatggacgtaaaggaattgaagaagcatacaaaacaggacgaggaaaaatctatgttcgtgcaaaagcggaaattgaaactaacgataaaggtcgagaaaccattgttgttactgaaattccgtatcaagtcaataaagcaaaattagtagaaaaaattgcggaactcgtgcgtgaaaagaaaattgaaggcatcagtaatgtacgagatgtgtcaaataaagagggtaaccgtgttgaagtagaagttaaacgtgatgcagtcggtgaagtcgtacttaataatctgtatgccttaacccaaatgcaagtgacgtttgggatcaatatggttgccttggatcatggtcaaccaaagctattaaatttaaaacaaatcattgaagcatttgttcgccatcgccgtgaagttattactcgtcgcactgtatttgaacttcgaaaagctcgtgagcgtgcacatattttggaaggcttggcaattgccttagcgaatattgatcctgtgattgaattaattcgtgcctctaaaaccgctgatgaagctcgtgtcggtttattatctcaagcttgggaattaggtaatgtagcaacaatgctcagtgcaacaagcgtagatagttctcgtccggataatttggctgataacttaggtatcatcgacggtaaatactatctttccgatgaacaagctcgtgcaatcttagatttacgcttacaacgcttaacggggcttgaacacgaaaaaattgttactgaatatcaagaaatattaattgaaattggcaaacttttacatattctaaacagtgcggatcgtttgaaagaagtcttgtgtgaagaactggaaaaagtaaaagaagagtttggtgatgcacgtcgcactgaaattacatcggcatccggcgatattaatttagaagatcttattacccaagaagatgtcattgttacactttctcatgcaggttatgtaaaatatcaaccgcttacagactatgaggcacaacgccgtggcggtaaaggtaaatctgcaactaaaatgaaagatgaagattttattgagcgtttattagttgccaatactcatgacactattctttgcttttcaagtcgaggcagattatattggttaaaagtatatcaactaccgcaagcaaatcgaggggctcgtggtcgtcctattgttaatattctcccattacaagaaaatgaacgtattacagcaattctaccagtggctgcctatgaagaggataaatttatcgtcatggcaactgccggagggcttgtgaaaaaaattgcgttaaccgaatttagtcgccctcgttcaagcggtattattgcacttaatttacgtgatgaagatgaattaatcggcgttgatattacagatggtaccaatgaaatcatgctcttctcatcacaaggtcgagtagttcgttttgaggaaaatgcagttcgagcaatgggacgtttagcgacaggggtacgaggtattaaactggcattaacaaatgatatttccgatgatgaaagtgcggtagaaattgaggatatttctgatgaggatacaaaagaacctcttgatctgaatgtagataaagtggtgtcattggttattccaaaaaatgacggtgcaattctaaccgctacacaaaatggttatggaaaacgtaccgcactttccgagtatccaaccaaatctcgtaatactaaaggggtcatctcaattaaagtcagtgacagaaatggtaaagtggtcgctgcaacgcaagtagaggaaaatgatcaaattatgctgattaccgatgctggtacattggttcgtacgagagtgagtgaaatcagcattgtcggacgtaatactcaaggtgttcgactcattcgaacatcggaaacagaacaagtcgttagcttagaacgagtttgtgatactgatgaagatgaagaaaatatcgataacgattttgaatagagaacagactaaatcatcataatttcaagggcgattatcgccctttctttatatccaaaaaatatgactctctaccttatttatacccacttaatatgtgcttttttagcttggcattactgattattcgagggctgatacaaatggataataaatcagcaaaaatactcaatccgctcttttttcctgctttactctgtctaagtgcggtcgttttttctcggattttttcataattgaaaaatcaataaaatatgtcattatttaatccctcatttctctacaaaaaagctattttccctttttggtaaagcaaatttttttgctatactcgaacactgcttttattaggagaaacaatatggaacaaatgccgaattgcccgaaatgtcaaggtgaatacgtatatcacgacacaattaattttatttgtcctgactgtggaaatgaatggactgacaatgaaattgaacaacaagacgaagatcaactcatcgtaaaagatagcaatggaaatatattaactaatggcgatgatgtgcttttaattaaggatttaaaattaaaaggatcttcagaagtactaaaaaaaggcacaaagtacaaaaatattcgtttagtaacaggtgatcataatgttgactgcggcaaattattactaaaatctgaatttttaaagaaagcttaaattataactatcatgtttatctaaattggagttgttatgaaaaataaaattctcggcagtgcattaatgatcgccggcacaactataggtgcgggcatgttggctatgccattaacctcagccggcatggggttttccatgacgttagtgctacttgcaggattatggttattattggcctataccggcttgttgtttatggaagtttatcaaactgcaaaagaaaaagatgtcggcgttgcaactcttgcagaacaatatttcggtttaaccggacgttttttggcgactattagcttgctcgttctactctatgccttacttgccgcttatattaccggtggcggctctcttttatcaggccttttaacaggtattggtgatgacaaacaaacttctcaaatctcaatattactctttaccctaattttaggtgcatttgttgtgattggtattaaaggggttgacggcttaacccgtctcttatttatcggaaaaatcattggctttattgcggtcttattaatgatgttacctaaagcaaaattagaaaacctaggggcaattcctttagataatctattggttatttctgcaattccaattttctttacctcttttggcttccacgtcattatggggagtatcaatagctaccttgatgcagatattcgtaaaatccgtttagctattattattggaacgttaattccattatttgcctatttattatggcaattcgcaacacatggcgtattaagtcaaactcaatttgttaacctattaaaacaagatccgaccctaaatggattagtaaaagcgactagtcaaattactggaagtagcctattaggtgaggtagttcgcctattctcatctcttgcattaattacttctttcttaggtgttgcaatgggaatttttgaaggagttggtgatctattaaaacgtattaatctgccgacaaatcgcccgatactggcacttttaacttttattccgccactagcctttgctctattctatccaaacggttttatcaccgcactaggttatgccggcattttatttgccttctatgggctacttcttcctgttgctttagcttggaaagctcgtcagttgcatcccaacctaccttatagagtcgctggcggtaatcttgcattagtcatcgcatttattatgggcatcgttattatcgttatcccgttcttaatgcaagaaggtatccttcctactgttgccggataaattaaaaagagcggttaaatttttataaattcaaccgctctttctattaaattttaaaaataatgcctcacaattcatattatgaagtgttacgtttatctaaaagcaatttagtctactattttttcggtaaaacgttcaattttcgcacccaatccacgtaattttttttcaatatgctcataaccacgatcaatgtgataaatgcgatcaacgatggtttcacctgtggcaatgcaaccggctaagacaagactgatagaagcacgtaaatccgttgccataacttctgctccggataaatattcaacaccatgacaaaatgctgtgttaccttcaatctcagcctttcctcccatacgaattaattcaggaatatgcataaaacgattttcaaaaatagtctcggtaattttacttgaaccctctgcaaccatatttaataaagtaaattgagcttgcatatcagttggaaaaccaggataaggttcagtacgtatatttaccgcttttggtctattaccttgcatatccaatgtaatcgtattttccgtgacttcaattttagcaccggcatcacgtaatttatcaattactgcatctaaagttgatgctttagtatttttacaaatgatacgtccgccggaaatagccgctgcaactaaaaaagtaccggtttcaatacgatccggcacaatactatgctcacaaccgcctaggcgttcaacaccttctatcgtgataatatctgaacccgcaccgctaatttttgctcccatcttatttaaaaatacagcagtatcagtgatctcaggttcacgagctgcattttcaattactgttatgcctttcgctagagttgcagccatcataatagataaagtcgcaccaacacttactttctcaataacaattcgtttaccgattaattgaccatcaacaaaagccttaacataaccgtcttccaatacaatttttgctccaagtcgctccagcccgctgatatgtaaatcaacaggtcttgcaccaatagaacaacctcccggtaatgaaacttgcccttgtttaaaacgagatactaaaggtgctaatgcccaaatagacgcacgcatcgtcttaaccaactcataaggagctacaaaatgattaatatttgaagcgtctaaatgcaccgcaccttgttcatctcgataagttaccacacctaattgttgcagaatttttaacgtggtatcaatatcttttaactcaggtacattagttaatttgacaggctcttcagctagaatggccgcaaacaaaataggtaaggcggcatttttagcaccggaaatattcacttctccatttaaacgagactgcccataaacacgaaatttttgcatatgttacttcctacttatgctacatattcaataaacgatcacgcttccactgttcagtactgaatgtttttattgttaacgcatgaatcgcaccggatttaaaatgtgccattaaaggtgcataaatagtttgctgttgttttagtctggacagttgtgcaatttcatcgtttacaacaatgacaccaaaatgtgcattttcaccctgaacatatacttcatcgagattcaatgcttcctttaaaatttgctcaatttgctgagtttccattaatattttccactattgtaaaaaaggcttaagccaatcagataagccaaaaagatctgccaaaatttccaattgaattggggcattatgaattttttgtgaacttacttgtttttcaagctcattaataaaatcacttagcaaagcaaaaccagcactatcaatgcgattaacttcactgagctcccaaacaagttgctgaccaacaagctccgcacttgataaaagttcatcacgttgttgcaaaaaaggaagcaatgtatctcgtgataacgctcccataattcggagcgtcatcttatcactatttttttctaatgcccaattcagattgttctctttcatacgttatttactactaataataattggttgtttagaaaattcttccatctcatcaatcaaagtttctataccttttttgcgtaaaataggtaaccattcctgtcttgttgagtgaaccgtactcacaccgttagcggacatatcatacacttgccacttacctgatttactgttcttacgccaataaaactctaaatcaataggtgcaacattgccgctttgcagtattttaaccggcacattcatttgatctgccgttacattaatcggctttaatacactaattttctgattactataaagcgtcaacgctttggcatattgatattcgataaatttatcaaataccgcaaagaattttgcacgttgttccggtgatgttgatttaaaataaggccctaacactaaagatcctgcataatttacatgagcatagggcatgagtccttgacgtacgatagtacgcaaataattaggatcttgtttaatcttactttggttagtatcaatggctttaaataaacgctcagatacatcaagcgttagttcataaggtgtttcttccgccatagcttgtacagcaaaaagtgcggtcattgccacaattattttaaaaaatagtttttttaacataaatattagctcctaaatctacagtgtataaaaaattattgaacatccggttccaattgcttttgagtacttttattttctttgctgccatataagaattgcccgacaagatcctccaataccatagctgatttagtatctacaatacgacttccctcttttaacatggaagtttcaccatcatcaaatccaacgctaagggaaatatactgctcacctaacaaacctgaggttttaattgacaatgaactgttatctggaatttcattgtacttttcatctatagcaattttaaccagcggtaaataggttttatcatcaagttcaattgatgatactctgcctattacaacaccaccgactttcaaaggagctctaactttaagtccgccaatattatcaaaaacagcataaacttgataagattttgcttgattaaacccttgtatattcgcaactcttaatccaagaaaaaccaatgccccaataccaattaataaaaataatcccacccaaaattcatgtttaactgtttgtctcataaaaaatccttaattttctaccgcactttatttatgaacctgcaccaaacatcaacgctgttagtacaaaatccaatcctaaaacaacaagagaagcatgcaccaccgttttcgttgtcgctttactaattccctctgatgtcgggatacaatcatagccgttgaataatgcaatccaaacaacagcgatggcaaaacataaactcttaatacaaccgtttaataaatcatatccccagctaacggagttttgcatcacagaccaaaaactccctgcatccacacctttccaatccacaccgactaaagaaccgccccaaataccgattgcggtaaaaataacggcaagaatgggcatagaaatcacacctgcccaaaaacgaggtgaaataactcgacgcaaaggatcaactgccatcatttctaagctggataactgctctgttgctttcattaaacctatttcagccgtaagagctgagccggctcgaccagcgaataaaagtgcggttacaacagggcctaattctcgtaacaatgataatgcaactaattgtccaagacttgtttctgcggaaaaatccactaacaccacatacccttgcaaccccaacaccatgccaataaataaacccgataacatgatgattaacaaagattgtacacctaatacataaagttgtttaataagtaaggggaaatgcttcctcatctgttgtttcccaaccaatgcaccaaaaagcataaaaccggctcgccctaaagaacgacaaaaatccattccccatctacctaaagatgaaataactcggatcatgaaaacaactcctgtacatagtcttgtgcaggaaaatgaaaatgaacaggtccatcttccttaccttgaataaattgcacaacttgcggatctcggctttgtaaaagttgctccgcacttccttcagcgatcactcttttatctgcaataatatacgcataatccgcaatacttaatacttcctgcacatcatgagaaaccacaattgaagttaatcgcaacgcttcatttaaacgtttaattaagctaataatcactcccatactaatgggatcttgccctgcaaaaggctcatcgtacatgattaactccggatcaagtgcaatggtgcgagctaatgcggctcgtcttgccataccgcctgacaattccgacggcattaaatttgccgcaccacgcaaccccacagcttccaatttcatcaacacaatttgacgaataagtttttccggtaaatgtgtatgctctcgaataggaaaagcgacattatcaaaagttgataaatcggtaaataatgcgccggactgaaataacattcctatgcgttgacgaactcgatataactcactattggacattttacaaatatcttgctcatcaaacaaaatttcgcctttttcaggttgaagttgtcctccaatcagttttagcaacgtggttttaccaatgcctgacggtcccataattgcagtaattttgccttgctgtacctgcaaattgagattgtcataaataattcgattacctcgcttaaaagttaggtttctgacttctattaaaggtcttgtcatagtttcttcattactctacttatatttgtacaaaatgagatcggatattccacgaatttccggtcattgtcaaattaaattatgatgattttcaaccgcacaatccaaacgagatgtctaagttaacaccccagactttaatagattattacatgcttttttaaaaactatgctatgattacgcaatttttgtcaaacacaaaacaatataaggattttatgcatattcgctggaatattattttatcggtgatagctcttgttttactcgcttggttttatactttacagccaaatgataatgaactcagtcagcttataaagtcaagtacacagccggaatacataggagaaaagatgtcaacctctgttttttcgccaacaggaaaaaaacaatatttagcgacagcagataaaattgaacactacaatgaggatagacgcacagaatttcaccaaccgctggtctatttatttgatattgatgatgaaaaattcggtaagcaaagttggaaattaagtgctaaaaaagctaaattaacaaaaaataatatgctttatcttgatggtaacgttattgcagaaactttattggataatgctaaattacaacgagttatgacagagagtgcggtagtaaatttaactactcaagacatcacctctgacacaatggttactataaaaggtcaaaatttcagctccacaggcttaaaactgaccggaaatttacaacaacaaattgcaaccttaaaagaacaggtaaaaacccattatgaaatcaacaacaaataagtatttattaattaccgcacttatgatgacttcaatatcagctttagccctaaaagatgatacaaatcaaccgatagatatcgtatctgaccatcaatcccttgatatggaaaactctgtggtaacttttacaaataacgtagtcattaaacaagggtcaattttaattaaagcgaataaagtcgttattactcgcccaacagaaaaatccaataaaaaagaaactgttgaggctttcggtaatccggttctctttaatcaattacttgataatggaaaacctgttcagggcaaggcgaataaaatccactatgatctcagtgccgaatttttaactttaacgggtaatgcggaattaaagcaactggatagcaaaattaacggtgaaaagatcacctatgatgtcaagaaacaacaactcaaagcaaatggagccggaacatccagagtaaaaacagtattaattccgactcaattcaataatcaacacaaaaagtaaccgggtaaattaatatgtctatactgcaggcagaacatctcgctaaaagctataaaaaccgtcaagtggtttctgatgtaagtttaacagtgaactctaatgaaattgtaggtttactgggaccaaatggtgcgggaaaaaccacaacattttatatgatcgtcggtttaatacgccatgatcaaggaaaaattcacattgataacgaagatatcagtttgttgcctatgcacaaacgagcacagcgaggaatgggttatctgccacaagaagcctctattttccgacgattgagtgtttatgaaaatttaatggcagtcttggaaattcgtaaagatttaaatatgcaacaacgtcgtactcgagctgatgagctgattgaagaatttaatatcggtcatatctgtgataatttgggacaatctttatcgggcggtgaacgtcgtcgtgtagaaattgcacgtgccttagctgcaaaccctaaatttattttattggatgaaccttttgccggtgttgatcccatttccgtaattgatataaagaaaattatccaagatttacgcaatcgtggattgggtgtgttaatcactgatcataatgtgcgagaaacactggacgtttgtgaacgagcttacattgtcagctcaggaaaaatgatagcaacgggtacacctgctgaagtcatgaataacgaacaagttaaacaagtttatcttggtaaagaatttaaattgtaattatgcttaaatttactgaattactctctcctgaaaatatccgtcaagggttaacttgtacaagcaaaaaaagagcttttgaaatcatatccagcttaattgctaaacaactttcagaacaaattgatggcttagaagcagatgaagttagtcttcaagaaaaagaaactctttgtaccgattctttactcaaccgagaaaaattaggcaattccagtttgggaaacggtatggctatgcctaaaggaagattacccctaggtaatacacctatcgcagttttcttacaactgagtgcacctttaaaatatgatgcacttgatcatcgtgaagtcgatcttatttttgccttattatccccgacagaacattgttccaatctcgttcaagaattgccccatttagtagagcgtttaaaagacaaatctctaattaaacaattaagaaacgcacaaagtgcggaggaaatttggcaaatttttcaattttcagatagacaggcggaaacattaccaactactgaacaacaccatgctgaaacaaaatatcccgaggaagaataaaaatggagattatcattattagtggacgctcaggtgcaggaaaatccgtagcattgcgagcattggaagatattggctattattgtgttgataatctcacgatggatttagttcctcaacttgttgatatgttggaaaacaaacagcatttagtagcaatcagtttagatattcgtaacttacctcaagaacctgaaacattggatcacatcttaaatttgctgcaagaaaaatatccggtaaaaattattttcttggatacggatagaaataccctaattcgccgttatagcgactctcgtcgtttacatccgttatcggtccaaaatctgtctcttgaagcggcaattgctgcagaaaaagagcatcttgaacctttagtacaacatgccaatgtaattattgataccacaccgctttctccccatgaacttgctgaacgtttacgtgaatttttgcgtggcaatacggaaaaagaattacaaattattgtcgaatcttttggatttaaatatggtattcctttagatgctgattatgtttttgatgtgcgttttttaccaaatccacattggaatcaggaattacgcccaatgacaggattagaaaaaccggttatcgaatttatgcaaaaacatattgaagttgacaactttatttatcagacacgtaactatattgaaaactggttgccaatgttagaaaaaaataaccgcagttatttaaccattgcaattggttgcacaggcggtaaacatcgttctgtttatatcgctcaacaaattggtgaatatttccgagcgaagggaaagaaagtgcaaatccaacataaatcattggaaaaacatacacaaaataaataaccccaaacttaaattcggggttattttgtcagtaattatttaactcgttgtcccgcttttgcacctgcatcaacatcaagtaaatataaatccgcaccaccgttgcctgcacttaaaatcataccttcagacattccaaacttcatttttcttggtgctaagtttgcgaccataatcacaaaacgcccctccaaatcttccggcttaccatacgccgctttaattccggaaaatacttgacgagtttcattgcctatatccagtataaatttcagcaacttattactttccggcacggcttcacatttcaaaacttttgctacccgtaaatccactttgaaaaaatcatcgatagtaatgctttcttcaattggctcaaactcggaaaatgctttattttctaccgcacttttccctgcggtttggttagctttcgcattttctatttttgaagcctcgatcatttcttcaatttttttcatatctaagcgtgagaatagaggtttaaacggtgcaatttgatgatctaacaaagggcttgctacattttcccaagtcaattgcgtatttaaaaatgcttctgcacgtgctgctagatttggtaggacaggtttcaagtaacctattaatacacggaataattcaatccccattgaacacacttgttgtagttcatctgtgcgactttcgtctttggcaataacccaaggtgctttttcatcaacatatttattggctttatcagtaagtgccataatttcacgaatcgcttttccaaactcacgattttcatagtagtcggcaattaactctgactgtgcaataaattcatcgaacaacattttaccatctaatttatccgccaatttcccgtcaaaacgtttttgaataaaacttgcatttcttgaagctaaattaactaatttattcaccaaatccgtatttacacgctgtacaaaatcgtccaaatttaaatccaaatcatcgatacggctgcctaatttagcagcatagtaataacgtaagcattcaggatctaaatatttcaagtaagtggcggcttgaataaacgtccctcgagattttgacattttctcaccgttgacagtaacgtagccatgtacgaaaatattattcggtttgcgtaaactggctccatccaacatcgccggccaaaataaactgtggaaatacataatgtctttaccaataaaatgataaagctcagcatggctctctttgctccagaaactatcaaaatcaataccgctctttttgccacagagatttttaaacgatgccatataaccaatcggtgcatctaaccacacataaaaatatttattgtcagtattaggaattttaaagccaaaataaggtgcatcacgagaaatatcccattgttgtaatccagcctcaaaccattcctgcattttatttgcgacttcttgttgtaaagaccctgaacgtatccattctgttaacattgccccaaaagcaggtaaatcaaagaaaaaatgttcactttcttttaataccggcgttgcacctgatactgttgaacgtggtgaaataagttctatcgggctataagttgcagaacaaacttcacagttatcgccatattgatctgccgccttacatttcgggcaagttcctttcacaaaacgatcaggcaaaaacatcgctttttcaggatcgaaaagctgagaaatagtacgagttttaataaaaccattttgcgttaatttgtgataaattgcttcaactaactctctattttcatcactgtgagtggaatgataattatcaaaactaatgttaaaaccattaaaatcagccatatgtttttgttgcacatctgcaattaattgctcaggttttacgcccatttgatctgctttaagcatgattggtgtaccatgagcatcatctgcacaaacaaaataaatttcattgccacgcattcgttggaagcgaacccaaatatccgcttgaatatgttctagcatatggcctaaatgaataggtccgtttgcatagggtaaggcacaagtaactaaaatttgacgtgaattcgttgacattaatttaacctttaaatatgaaaattttgttgttcatcttaccttattagtggtattttttccagctctcgatactttacaatcgtagttatgctatgatgaccgtagcaatttaacttgtttctttaggaaaaaagaatatgacaatccatttttcatataacctctctgaatcacaaaaacaacagttacaagaatgtttccgacaatttagtcatactactttacaaaaagatttaattagcttaggtgcggtcaaaaaaatcgaacttggcggcaatatgttacgcatagagttagtgatgccctttgcgtggaacaccggttttgcacaattaaagaccgcacttagtgataaattagatgcaatcacacgagcaacagaaatcaaatggttacttagctatcaaattgccactctaaaacgagcaaataacctgcctgctgtaaaaggtattaaaaatattattgcggtaagttccggcaaaggcggggtaggaaaatcaacaatctccgtcaatcttgcactggcattacaaactcaaggagcaaaagtaggtatcttagatgcagatatttacggaccttccataccgcatatgctaggcgttagtcagagccgccctacttctccggataatcaacatatcgatccaattcaggcacatggcttagctgccagttccatcggttttttaatggagccggacagtgccacaatttggcgtggcccaatggcaagtagtgctttaagccagttattacaagaaacactttgggcaaatcatggcgaattggattatttggtgattgatatgcctcctggaaccggtgatattcaattaacgttatcacaaaaaattcctgttaccggtgctatcgtcgtaactactccacaagatattgcattacttgatgcaatcaaaggaatttcaatgttccaaagtgtacaagttcccgtccttggtattgttgaaaatatgtcggttcatatttgtagtcaatgtggtcatcatgaaacgattttcggaacaggcggggctaaaaaaatggcacaaaaatatcaaattaaactcttggcacaactaccgttacatattcaattacgtgaagatatggataacggtataccaactgtcatttctgctccagaaagcgaaatatcgcaatctttcttacaattagcagaaaaagtagctactgaactttattggcaaggtgaaattattcccggagaaattttattcaaagaagtaaattaatatccaagaaatttctagcgtcgggtttgtcctctcttgttcgggctatgatagcatttctctctaattcagcaaggacgcttaatagttgagttaatgctatagaaagaggggtattccgtgctgttgtatcgaacattccgtctagtgttttaaagtcgatttttctatcgtgaaattcagttataacacctataacttgtaatgcaccctgacctatctaggctagcaacaacatcccccctctcggatataattcagtaattctagcctttctgcattattttccctagttccctgaattttgcagcctgcttttttaattggtttatttggtcttttaagtcctgcttatgagttgatactccagcaaatccaacgaaagctatttttacctctattcaaaaattacataataaaaacaaatatattgattacttctattttgaagctgtttgcgagtaggtatttaaacgagaaaatttcaacacatcaaattcatcgtgtataacgtattggtaaatcagtactaaattaccttgaatatgacaatctcgctgatctttccattctccaactaatgtgtgatcttgatagctttcaggcaatggcaagcggtttaacaagcagtgcattgctgtaatatatttcgttcctactagcacatttgggtaacgttttgccaaatcagtcaaatctctagcaaattgtttagagtaactgacctttaattgtttactagacattagttacccgttaagaatgcgttttgtaaactcttcgacagaataattttctccagcttcaataaaaaagctctctgcattaccgctatctaattcgtccatagctgctaaggtttctttatttgggcgaagataattcaaatcaacagggatagagcgagtcttggcaatttgagccaaaaacatattaaatacttgtgatggtgtaagaccatattgttcaatgatctgataggcttcggatttagtttgctcaactgctctaaagctgatagacgcatttgtaagtgccataagttttctccatagtattacattgaaagactattgtggtaagaatgaagttaaaaatctacatttttaatgtgattagggattttcatttttaattgctattcaaaagttttcaatgtatatttttgaatatagtcaaaaataaaaacggagcgttacgccccgtttaatttatttttcactttcttccaattcgtctgccatcgctgataaaatttctctagaaagcaaaactaaagcacgataaaagggtaaatttgcatgcttttctacttggttaaaaaactgactagcacaaggtaacaaaaaaatttcaaatagttctcgctgggcttgaatggaatttaaattatcttcaatccaagaggcagttaaaaaaaccaacgcaaaatgatccgcactttctaccactgggcatcctcgctcttgtctaaacgaagaaaattcatccggattaattccataatcagagattttcattgaaataagtggcgtatcagtcataaataaacgctgatattctatttccagtgcgtttaaatccattggtatttgcaaactatctaacgcctctttactttgtttatctgtttccaaacaccaaacctgttccaaacctttttgttgtaaccaagaaaatacgtcagtcattataggatctgtcggttgacgataaaataaattaccgaacaatcggcttattaaggaaaaattattcatttgatctacaatcacgcaataccttccttttgtaacgctaaaagagcggtgagatttttcactgttttttctcttacttcttgcaagatatgttgcttagcttgttcatctaaaatgtgaatatcaccgaaaaaactatgatcaatatcagtaactccacaataattaaacagaccatcaactaagcaattttgtaatgattgtgcaaatccacgttcttgatatttctgtaaattattacccatagtaataaattgttgtatttttttaccatgtaaaagcccctctgaaacgccattttccgttttgtaggcaaccccatggcttaaaatacgatctaaatagccttttaagattgcaggaaatcccatccaccacaatggataaataagtgtaataagatcagattgatcgattaattcttgttcataacgaatttctgctggtgtgattttttgttgtgccgcctgtaattcttcccaagataaaatcggattgaaatcaagagcatacaaatccctaactcgtgtttcaatccccagcttttgaccggtctttacagtttgctctaatattgcttggttaaaactcgtctgattattagggtgagtaaaaataattaagtgtttcatttctttctcttattttttttgaacaatcaacgtaattccattcacagcttgaacttcaataatatccccttgttgcaaccctttaccttgaatacgccaagtggtatcgccaaaaacacctcgaccaatgccattttcggctatcacttcaaccttacctcgacatcccaacatggcgtgatctcgccggtttaaagaagaatttgcctgatctttttcatctttagtatgttgatatttccaccatgcgacactcaacactattgctaagatgccataaataacgcactgtatagtcagagataaatcaataatgatggtgatcattgaaacaataatagcggctaagccccaccataataaaaaaacgcctggaacaattatctctgcaatcaataataaaaaacctaaaatcagccaatgccaaaatgtccaagcgtcaaaccattccattttacatgtttcctctcaatagaggacgcctaagcgtccattgatattactgtttattgccttttaacaattcagcaatgcctgcaacagaaccaattaaatttccggcttcaagtggcataagtacaatcttactattatttgcactaccaatctcttttaatgcttcagtgtatttttgagcaataaagtaattgattgctttagtatctccacttgaaattgcgtctgacaccatttgtgttgctttcgcctcagcttcagcagcccgttcacgagcttcagcctgtaaaaacgcttcttgacgttcaccttcagcttttaaaattcgagactgtttttcaccctcggcacgtaaaatttcagcttgacgcacaccttcagcctctaaaatatcagcacgtttattacgttcagctttcatttgtgcattcatcgctgcaatcagctcttgcggtggacgaacatcacgaatctcaatacgtgttactttaattccccaaggattcgttgcttcatctacaatagctaataaacggctgttgatattatcacgttgagaaagcatttcgtctaattccatagaacctaataccgtacgaatatttgtcatggttaaattaatgatggcttgttcgaggtgattgacttcataagctgcacaacgagcatcaataacttgcacaaaacaaaccgcatcgatagacacattagcattatctttagaaataacttcttgcgatggaatatctaagacttgctccatcatattaatacgacgaccgacacgatccacgaaaggtacgacaaaattcaatcccggtgttaaagtgcggatataacgcccgaagcgttctattgtccaatgatagccttgaggaacggtttttaaagttgaatataaaataaatacaattaataaaataaaaataatcgtagcaattggtaacccatcaaatagctccatttcatactccttgcaaaataaaacaaacacaatataaaaatactaccagcatatagtagcttattttagtttatttatctaactaaagtgcggtctgaccaagaatataagatacttattttttagttaaattcgtgacaattttagttaattatttctttatttgacttttattaccacttaatccagtctgtttcattggtttgaccacaaccatcactacgtttttataaaaagcagtatacggtataatagtttatccatcataaaaaggtaaataccatgtctagatatgcaaaaattttattgttaaacggccctaacttaaatatgttaggaaaacgtgagcctacacattatggcaatctctctttagaagatattgaacaacgcatgcaagaattagctcaacaacatcaacttgagctaagttgctttcaagcaaatagtgaagaaaaattaatagataaaattcaccaaagctttcatctaatcgattttattattatcaatcctgcggcttatactcataccagtgttgcattacgtgatgctttgctatcagtatctattccatttgtagaagttcacttatccaatatccatagacgagaaccttttcgtcaccactcttatcttagtgatattgccgaaggtgttatttgcggattaggtgctcaaggttatgaatttgcattacaatatgcctcgaactatctaaagaaaataaaataatttgcataaattttaccgaatttcacagaaatttatcgcaaaaatttattttttcaggtaatctctcgggcgaaataattcattttaaattaaccgcacttttttatcctcaattttgtctaaattggggattttaatggcgatttatttatgaacagtattaattttagttattttaggaaatcattatggacgttcgtaaaattaaaaaacttatcgaattagttgaagaatcaggcattatggagcttgaaatttctgaaggagaagagaccattcgcattaatcgtggcacccctgtttccaatcctattcaatataatgttcctgttacagcacctacaccagtagttgctccgcctacagtttcggaagcaaccggtacgccagtaacacaagtaaatgaagagccgtcaggtcatattattcgctcaccaatggtcggtactttctatcgtagcccaagcccagaagccaaagcttttattgaaataggacaacatgtcaaagttggcgatacactttgtattgtcgaggctatgaaaatgatgaataaaattgaagctgataaagcgggaatcatcaaagcaattttagtcaatgatggcgaacctgttgaatttgatgaatctctgattgtaatcgaataattattttacttttataggatttttaccgtcctacaacattattccaagagatagattcttatgttagaaaaagttgttattgccaatcgtggtgaaattgcattacgtattctgcgtgcttgtaaagagcttggtataaaaactgttgcagtacattcaacagccgatcgtgagttaaaacatgttttattggctgatgaaactgtttgtattggtcccgcaccttccgccaaaagctatttgaatattcctgctattattgcggctgctgaagttactggtacagatgcgattcaccccggctatggtttcttatccgaaaatgcggactttgctgaacaagttgaacgctcaggttttatttttatcggtccaacagcggatgttattcgtttaatgggtgataaagtttctgcaattaatgctatgaaaaaagccggtgttccttgtgtacctggatcagacggtcctttaggtgccgatattaataaaaataaagaaatcgccaagcgtatcggctatccaattattattaaagcctccggtggaggtggtggtcgtggaatgcgtgttgtacgtgatgaaaaatcattggaagaatctatcgctatgactaaagctgaagcgaaagcggcttttaataatgatatggtttacatggaaaaatatctggaaaatccacgtcatattgaaatccaagttttagcggatacacatggaaatgccatttacttagctgaacgtgattgctcgatgcaacgtcgccaccaaaaagttgttgaagaagctccggcaccgggtatttcagaagaaacaagacgtgatattggtactcgttgtgctaatgcctgtcttgaaattggctatcgtggtgccggtacatttgagttcttatacgaaaatggtgaattctacttcatcgaaatgaatactcgcattcaagtagaacatcctgtaaccgagatgattaccggtgttgacctggttaaagagcaactgcgaatcgcagcaggatttccgctttcaattaaacaagaagacataaaagttaaaggtcatgccatcgaatgccgtattaatgcagaagatcctaagacctttttaccatcccccggtaaagtaacacacttacattctccaggtggtttcggtattcgttgggattctcatgtttatggtggatatacagtgccaccacattatgattcgatgattgctaaattaattacttatggtgatactcgtgaagtagcgattcgtcgtatgcaaaatgcattatccgaaactattatcaatggtataaaaaccaatatacctttgcataatttaattctttccgatgaaaatttccaaaaaggtggaacaaacattcactatcttgagaaaaaattgggtatgagagattaatatcactctcattgagttataaaaataaaagcaaaagtggataatagtatccacttttttatggataaaaaatgaaagtacattacaaacaatcagctaaagaatctcgctatgccttgttcttaacagtgctatatcttatcggctggtgcatttttgcctatttacctgatgaggcaagaggtccgcttggttttcctctttggtttgaattgtcttgcatatactttcccatagtgtttattatcatcgtgtatttgtgtattaagttcttttttaagaatctatcattaggagaggaaaaatgaacattaatatcattttacctttggttctctacttgctctttgtattcggcattgcttactattcctatcgtcaaagaagtcaaggcaatttcttaagcgaatattatattggtaaccgctctatgtcaggctttgtattagcgatgacgacagccgccacttatgttggagcaggatcttttataggcggaccgggtgccgcatataaattcggtttaggttgggtattgttagccatgatccaagttccggtagtcttgtttactttaggggtactgggtaaaaaattagccatgctggcacgaaaaaatcaaagtttaactgttaatgatattttattctctcgttataaaaatccctatattatcctactggcaagcctttcattgctgttttcgttctttataatgatgtccgtgcaatttatcggcataggtcgtttattagaaactacattacatatcgactaccacatttcagtactcatttttgctaccactgttggtatttacacttttataggaggctttagagcggtagtactgaccgatactatccaaggcctcatcatggttttgggaacctttttattactgggcggtgtcatttatgcaggaggcgggattagccaacttattgatcacttagctaaaattgatccgcacttaatcacgccttatggcactgatgacagaccgcttgattttacatttatggcttcgttttgggtattagtctgctttgggttactaggtttacctcatacagttgtgcgtgctattgcctataagaatagtaaggcattacatagcggtattattatcggtacaatcgtcatcgctgtactaatgctcggaatacatttagccggtgctttagggcgtgctgtaattccaaccttagatgtaagtgataaaattattcctactttgatgatacaagtattaccacctgtagttgctggtatttttcttgccgcaccaatggcggcaattatgtcatctgttgactctacattaatccaaatgtcctctactttgattaaagatctatatttacgtttttaccccgctcaaatacacaatgaaaccggaataaaacgcctatcaatattaacaactttatttctaaccttactcgttaccatagcaaccttaaatccgcctgatatgttgatctggttaaatttatttgctttaggtggactggaaaccacatttctatgggttatgttatttggcctatattggaaaaaagctaacgcttatggtgctattagttcaatgttagtcgggctaataagttacatattacttaccgctcttgacataaaattatttaatttccacgctattattcccgctttattatttggcttaattgcattcttattgggaaatcaagtaggaaataaattgattaaaaatgaggaaaaataaatggcttgggtacaacttcgtttaaacagtacaaatgaaaaagcagaaaaaatcagtgaatatttagatcatctaggtgcggtgtccgttacgtttatggacagccaagacacaccgatttttgaaccgctaccgggggaaacccgtctgtggggaaatactgatgtgattgccttgtttgatgcaaaaaccaatatgcaacaaattgtccgcctattgcaacaaaaaaatcatcttgatgaaaatactgcttataaaatcgaacaaattgaagataaagattgggaaagagaatggatggataatttccatccaatgaaatttggaaaacgcctatggatttgtcctagctggcgtgaaatacctgatgaaaatgcgataaatgtcatgcttgatcccggtttggcttttggtacaggcacacatccgacgaccgcactttgtttagaatggttagacagcttagatttaacaggaaaaactgtgattgatttcggttgtggttcaggtattttagccattgctgcccttaaattaggtgcaaaaagtgcggtcggaattgacattgatccacaagctattctcgccagttataacaatgctgaacaaaatggtgtagcagagcgtttacaattatttttatcagaagaaaaaccaaccgatttacaagcagatgtggtgattgccaatattcttgccggtccgttgaaagagctttacccgataatcagcaatttagtcaaaccacaaggtgatttgggcttatccggtattctatctacacaagcagactccgtttgtgaagcctatcaagggaaatttactcttgatccgataactgaacgagaggaatggtgccgaattaccggaaaattaaactcatttgtctaattcatttatatgattttatacaaaaaataaaagtaaatgatataaaatttaaccaatatcaaaaaaatgtaatttgtataaaaaatattctttgcaaatgacttaaaagtgcgtatcataacgcaccttgtcgccttgactagcgaaagcaataaatctgatataacataatttggagaagcagaagtgcaaattggttcttatcaattaaaaagtaatgtacttttagctcctatggcaggcataacagatcagccttttagaaggctttgttctttttatggagcaggtttgacttgctctgaaatgatgtcagccaatccacaagtttggcatacagaaaaatcaagattgcgtcttgcccatcatcaagatgcgggaattaacgctgtgcaaattgctggttccgatccgattgagatggctcaagccgcacaagtaaatgtagaatatggtgcacagattattgacattaatatggggtgcccagctaaaaaagtgaaccgtaaattagcaggatctgctcttttacaatatcctgacttagttaaaaaaattctatattcggtagtcaaagcggtaaatgtaccggtaacattgaagattagaacaggctggaatcaagagcatcgtaattgtatcgacattgcaaaaattgctgaacaagcaggaattcaagcattaagcatacatggacgtacacgtgaatgtttatttaatggaaatgctgaatatgacagcattaaaaaagttaaagaacaaatttcgattcctgttattgctaatggtgatataacaaccgcaaaacaagcacaagaggttctcagttatacgggaacagatggaataatgattggacgtggggcattaggtaaaccttggctatttcagtcaatagtaagcttaatcgaaacaggtatcactattccggagccaagtttagatgaaaagtgcagcgtgattttgcaacatattcgtgatctgcatcagttttatggtgaagataaaggatatcgcatagctcgtaagcacgtatcttggtatttagagggaattcaacctaattccgattttagacagacttttaatgcaattacgaatgctaaagcacaactaattgcactagaagatttttttaattttattttattggataaagaaacatgttagaacaacgtaatccggctgaagcattaactgtttcagtattaaattcacaatctcaagtaacaaataaaccacttcgtgattcagttaaacaagcattaagaaactatttatcacaattagacggtcaagatgtgaacgatctttatgaattagttttagcagaggttgaacaccctatgttagatatgatcatgcaatatacacgtggtaaccaaacacgtgcggcaacaatgctgggcattaaccgtggcactttacgtaaaaaattaaaaaaatatggtatgggttaatttcccttgctgaaaaaataaggtcgctaatttggcgaccttttttaattactctatttcaatttttttaataaattccgaactcaaatctaacaacggtaaatccgagccttgccaagaacgtaaaatttgataatccattaaacttaatgtatccaaccctagagtaacatttggtgtatattgttttgcgatacgagctaattgggtcaaccctaaactgctttcaatagacgagctgatcactgcttttaagcccaattgatgtgctttttcgattaatttaacacaatcttgcaacgaaccaatcaaagtaggcttaattacaattgctgctaagtgcggttctttttctaatttaaatccttgttctcgaatactttcgtcccaagctaacgctatacctgtatcctgtgcaaattgacgactatcgtcttgcgtcttacaaggctcttctaagaactgaatacgcttgcgatgttcaggctttacatatttggcaaacaactgtgctttcgacaacgtccaactacgattagcatcaagacgcaaataaagatcgggaattgcttctaacaacatatcagcaatcataccatcacgatttgcttcatacatgccaaccttaattttagctaccttctcccccggaatttgatttaatacatcataaagctcatcaggatcgccataacataacggggcgacttgatagtttccttcttgaaccaattctccttccatttcagccaaagcacaacttaagccaaaagcaacagacggatatagcccttgcaatgaaaatttttgatttgcagatcttgcctgctcccacttttttaaccattgaacagtttgctctttcgcctgttctagagtttcttggctaaattcaggcaaaggggcaatttccccccaaccttcatgctcaccacattttatttgcacaaacaacccttcacgtttcttcaaaaagcgattgcgcaaaataagctggctatccacaggaatagcatattggtataaatgaaaaattcgatttgtcattactgttcacattgttgtgtattgtcattataacgaccaccataatctaaacagtgatcttttgcatcaaaaataacgaaagtggcaaaaatacctagcaccactaaaatcagtaaaagaaacaaccattttttcaacattattttttcctcaaacaagacaaaagtgcggtcaaattttccactattcttaccgcacttttactgattaaatttatggatttcgcttaaatttactgaaatcaggtgcacgtttttcattaaacgcattgcgtccttcctgcccttcttccgtcatataaaataacatagttgcattacctgccagctcctgtaaacctgcttgaccatcacagtccgcattcaaagctgctttcaaacaacgcaaggcaatcgggctgttgcgtaacatttcacgacaccaacgcaccgtttctttttctaaatcagcgtaaggtacaactgtattgaccaatcccatttccaatgcttcttgggcattatattgacgacataaaaaccaaatttcacgtgcttttttctgcccaacgatacgagccatatagcttgccccccaaccaccatcgaatgagccgactttgggacctgtttgcccaaaaatcgcattttccgctgcaatagttaagtcgcataacatgtgtaaaacatgtccacctccaatcgcataaccggctaccattgccaccacaggttttggacaactgcgaatatcacgttggaaatccaacacatttaaatgatgcacaccgctttcatctttatagccaccgtaatcaccccgcactttttggtctcctccggaacagaaagctttttccccttgaccggtaagtacaattacaccaattttttcatcaaaacgtgcatcggaaaaggctcgaatcatctctttaactgtttgtgggcgaaaggcattacgaacctcagggcgattaatagtaatttttgcgataccgtcagtagatttatgatacaaaatatctgtataacctgaactgaaatcctgccattcaacaggcacataaagcacatcatcatttggattttgcattatttattccttttttattaagtcaatttgtggttggtattatagcttaaataccaataaaaagtgcagtcgtttttgtggaatttttacttggaacagcccattactccgtagcatattgaataaccttcgtgtatgctcatactgagttaattaatctatctgaacaaaaaaatcgcatgaataattagtcatctaaaaccgaatacaccatcttatttattctgcataattaaaaaaacgccacagttctatctgtggcgtttccaaatttgagcaaaataaattatgcttgacctttaaccgcttttaagcctaaaaacggtgctttctcacctaatgcttcttcaatgcgaattaattggttatattttgcaatacggtcagaacggctcatagaaccggttttaatttgaccagctgctgtaccgactgccaaatctgcaattgttgcatcttccgtttcaccggaacgatgtgaaataactgcagtataacctgcatctttagccattttaatggcggctaacgtttcagttaatgaaccgatttggttaaatttgatcaagattgagtttgcaatccctttttcgataccttcttttaagatcttcgtattggttacaaatagatcgtctcccactaattgaactttatcgcctaatactttggtttgatatgcaaaaccgtcccaatcagattcatcttgaccatcttcaatagatacgattgggtattcttggcataagccttctaagtagtgagtaaactcttgagaagtgaaagatttaccttcgcctttcatttcatacataccgttttctttgttatagaattcggaagaagcacagtccattgccaatgttacgtctttacctaatacataacctgctttttctaccgcttctttaatgcaagcaagtgcggcggcgttagactcaagattaggtgcgaaaccgccctcatcacctactgcggtgcttaatccttttccttttaacactttcgcaagattatggaacacttcagccccaatacgtaaagcttcttttaatgttttcgcaccgaccggttgaatcataaattcctgaatatccacattgttgtcagcatgttcaccaccattgatgatattcatcatcggcaacggcatagaatattcacctggtgtaccgttcaactctgcaatccaagcataaagaggcatacctttagaggcagctgccgctttagcatttgctaaagaaaccgctaaaatagcatttgctccaaattttgatttattttccgtaccgtccaattcaatcatgatttggtcgatttcagcttggttacttgcctcttttccaactagtgcggtagcaatttcgttatttactgctgaaacagcttttaatacacctttacctaagaaacgagctttgtccccatcacgcaattctaatgcttcacgtgagcctgttgacgctcctgatggtgctgctgccaatccaacgaaaccaccctcaagatgaacttcagcttcaacagttgggttgccacgagagtcgatgatttcacgaccaattactttaacgatttttgccattttgttttccttctatagttaatctaaaataagtataaaaactggcgatatagtaaagctatttcgtatgtttgtcttgtaaaaaagcactttttttgattttaatccatataaattgaaagaaaaaatactcttacatatttatttttgtaattttataaaattacaattatttatattgccagtatggagaatatttattaaaattctgctatgtcatttaaataaggtatagttttatgttgttaagtaatattgtggagatcagtagcggacaggcacagtttcgtctttccgaagtcagtgatccgattgcacctgtttatacttattatggtcaggcaaacttagaacaagatctctatttatctgatggttcagcagtacttcctaaagaaataaaaacttttgataaaataaccagtttactttccactggtgatgtgatttttagtctgatttcaggtaaggcaacgattgtcagcaaacaacaccaaggttttttatatactcaaaattacgttaagttaatacctaaaaatcagatagatgccaattatttagtctatttattaaacgaaaatgcggtggttaaaaagcagttaagtcgtggtttgcaaggatctcaagtattgaaatatacgactaatcagctgaaatcattgagattacccaaattaccccacttatcggaacaacgtttaatgggagagatttacctaaaacaacaaaaattagcttatctcaaacaacgcatagcgaatttagaaaaattacttgtgttacaccaattgcaaaagcgagtacagcatgactaagaaaatacccgaattaaaatttgaaaaaaccttaattgaatatctttgtacaggaacgattacggcaacggataatataattggcgaaccgcctgcggattatgtagtgcgtaccaaattgtggcaatatgagccaagcattaaaacgacggaagatttatgggaaaattttaaaagaattttagaaaagctcaatcaaaaaaccttagatcgtcctttaagtgcggtggaatttgcacaagttaaacgtactatttctaatttatccacgccttatgccgcaggacagtttctttatggcacaaacggtgtgtcacaaattgaaattgatttagatgatgatcgtcatgtgtttttaaccgtatttgaccaaaaacaaatcggagcaggcgatacggtgtaccaaattgtgaatcaaattaaacgaccggcgattattgcaggaaaagaaaatcgacaatttgatactacgttgttgattaatggcttgcccattattcaaattgaagaaaaaaaagaaacgcatgatattaacgaagccttaaatcaaatgcaccaatatatcgcggaaaatcaatacagcgatattttttctacgttacaaattctgattgcgattacaccaaacaatgtgaaatatatggcgaataccacagcggatcgctttaataaagattttgccttcaactggcaacgtcaatcggacaataaaccggtttatcactggaaagcctttgccgattccatgttgagtattcccatggcacatcaaatggcgactaactatatgattttagatggtacgccgaataaacaaaccctaaaagtaatgcgaccttatcaagtttatgctacgcgttgtgtgatggataaactcaaacgggcggatttcgatcaagcgttgaataaactcggttatatttggcataccacaggttcaggcaaaactattacgagctttaaaaccgcttggctggcaagtcgttcgccgaaagtggataaagtggtttttttagtggatcgtattgcactgactaaccaaactaccgaaaactatcgagcttatgatcctgatgccacggaagatagtctaggtagtgtactggataccaacaacaccacagatttgaaccgcaaattacatagcaaaggcagccaaattattattacctctgtgcaaaaactggataccttggttaaacgcacttctttcaaagcacccgaaaaaaacattgtgtttattgttgacgaagctcatcgttctacaggcagtgataattttgctgcgattcaaaaaaaatttaaacattctgcgtggattggttacaccggcacgccaatgtttgatgacactaccaaaggcttacgaactgaagatattttcggtgaactcttgcacgcctataccattcgagaagcaattgctgatcgcaatgtgttgggttttaaagtggattttgaaaccacgattagcgaaaaaagtatgaaagaagcgcatctaccgaaattctatcgccttaaatatcctcattggacggaagaacaaattgccttgaagattgccaatctcacgcaacaagatatggacgacagcatcgaaccgagtttttatgacgaaaatgaagaacacgtcagattagtggtggaagatattttcaaacattggaaaaatcgctccaattgggataacaaacgtaatcgtggacgatataacgccttgctgaccacgcacgtgggtggcggcaaagccagtacaccaatggcaatgatgtatttccgtgaattccaacgcatcaataaagtgcggtcagaaaagggggagtttttgctaaaagttgctgtgacctttagccaaaataccagcaataacgacaccatgcttgaaaccaaccaaggattattcgaggcaattcaacattacaacagcgaatttggcactaactttactatgtctgatgtatcggcttatactcaagatgtcaccagccgtttaaatcgcaccgctgtggacaaacaatatttagacctcgtgattgtcgtagatcagttactaacaggatttgacgcccctgaattaaatacgctttatgttgaccgcactttaaaaggtgcagggcttattcaagcctattccagaaccaatcgtgtagcggatatgcgtgaaaaaccttgggggcggattatcaattaccgctggccagcccataatgaaaagttaatgaatgaggcgttgtccgtttacgccaacaaagattccgccaaattatccgatgaagagcgaaaagtgaataataccaaggataagattactgcaccaaaatacgaagaattgctcgatgacaccaaacagattgtggaaaatctgcgagaaataacggataactttagccaattgccaccgtctgaagcgaaaaaatggaaaatgttggaacaattacgcacctataccgccaatattgccaaaatcaagcaatattctgcggaagatgaaaatggtgaaattatcggttttgattatgaaaatccggataaattgattcaagaactcggcatgaccagtgaagaagaaagtatgctcaccaacacattgtccaacgaactcaaactgcatttagcaaaaagccgaaatgtgccactgatacaaattgagctacaaatgacccacgttaaagacgtggaaattaattacgattacttaactgaattaatttccagcttgttggcacaagtagaggcaggtgaaacggaaaaagccaaagaaacggaaaaagaattggaaaaatttgccaacggcttggaagatcgcagttttgcacaacgcattaaccgtgcggcaaaagcgattatgaaaggtgtgttcaaattaaaagacgggtttaaaaaagacggcatttctattgtggaacaagcgaataacgccaaccaagatcaacaatttttggattttcgtctccaatggggattaacggaggtgattaccaacgcccaacttcgacagctttttgccaaacatcaatttcaacaaaaagatttagatgacaataatcagcttacggatttaatcaaacaagcaggtctcacttatcccgaacttgcacaaaatgatgaagtaaaaaaactgacaaaaatgaaataccgcaaccggttgcgtcataccatttacgaacttgcagatgagtttgtgggggaataaataatatggaaagaaaaatcaaatcttggaaagattatgatgacttacttaagttattgagcattcgaaaaatggatgttgaaaatcaacaacgtacattacattatttaaaaaatataggatattaccgattaagtggatactggtatccatttaagcaaaaagatgagcaaaattcccaaaaagaacaaaaaactatattactagatgagtttaaaacaggaacttgcttttcagatattttagccctttatatttttgataaacagttacgttttttagcgttagatgcactagaacgtattgaaatggcagttagaaatgatgtggtacatttattgggtaaattacatccactggcacatattgagccttatcaaatagatcaggatacaggaaaaaaagtttgttatttacatcctaattttattgcaaaaggggataaatattccaaatggaaagataagcataatcagcttattaaacgagctaggaaccgagatgctattaagcattacaatgaacaatatgccggcgtattgcctatttgggtttctgcggaagtttgggattttggcttgttatcccagttattttcagggttacggtataacgataaaaatacgattgccgcaaaatatggcgttaaagacggaaaaacatttgaacaatggctaaaaagtttaaactttattcgtaatgtttgtgctcaccatagtcgtttgtggaatttaaatatcattaatacatcggcaccactagaagaactgagttcaataaatcaatatcgtatcttcatgtacttgtgtatgatgcaaaagttattgacaataattaaccctaaatccacttggaatgagcggttatatcaattactaaacacattccctgaacctaaaaataaggcggtttcagtgcatgacataggattaccaaaagactgggaagaattagaaatttggaaaaatattaaagacaagaaatgagaactgacgcgtgcaaaagcagaggcgtcagtcatattggtgctgatagtatcacatcttatattttttgcaaaggatagaaaaacaaaatgaacaatgaaaaaagacttgtaccgaaattacgattccccgaatttactcacgcttgggaacagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagaacaacaaaaaatcggtacatttttcaccgcacttgatcgctacatcaccattcatcagcgtaagttggaaaatatgcaaaaattgaaaaaatcattgttgcaacagatgtttgtttaataaggggcaaagatgagctattccattgaatatacacaagaaattgatcggttaagcaaagaaaatgcctatcgactttatgattcaggcgatattcatcgcttagaagtcgggacaacgaaaggcttgcaagatattcatcgttatttatttcaagggctttatgattttgcaggcgaaattcgtgcattaaatatttctaaaggacattttcgttttgctaacgcactttatttaaaaccggcgttaagtgcggtggaaaaaatgcctgaatcaacctttgagcaaattattgaaaaatatattgaaatgaatattatccatccctttttagaaggaaatggtcgttctacacgtatttggttggatttgatttttaagaaaaacctaaaaaaagtggtgaattggcagaaagtggataaaaagttgtatttacaagcgatggagcgtagccccgtgaacgatttggaaattcgctttttattacaaaatgcgttaacggatcgcattgacgatcgtgagattttcttgaaagggattgaacaatcttattattacgaacaagccgaataaactgatttaaagtgcggtcataaatacagaattttttaataaaggaattaaatatgagcaatgtacaaacaattaccagtaaactttgggcaatggcaaatgagctgcgtggcacgatggacgcttcagaatataaaaactatattcttgcctttatgttttatcgttatttatccaaacaccaagaactatatttggtcgataatcatattttggacatagagccttcgcaaagtgtgaatgacgcttatttaacgcaagccacaggtgaggaattacaagattatttgcaagatatttcagccagtcttggttatgccattaatcccgaagatacttgggattcattaatgcggaaaatttacaatgccgaagtgatgccaagtgattatcaagccttatttgataacttcaaccaaaacgccaatttaaatgaagatgcggtggtagatttccgtggtgtgtttaatgatttgaacttaggagcttctcatttgggcaattctaccaatgagcgtgcgaaatctttaggcaatattgtgaaattggtggacgagattgaatacaaagatgatgacggtcgagatattcttggtgaaatttatgaatatttgatcgggcaatttgccgccaatgcaggcaaaaaaggcggggaattttatacaccgcaccaagtttcaaaaattttagcgaaattagtaacgctggatgtggctgataatcaagagactttccttgtttacgacccaacaatgggatcgggttcgttattattgacggtaggtaatgaattgccacaatcgaaacccattaaatattatgggcaagagctgaacaccacaacgtataacttggcacgcatgaatttgatgatgcatggcgtatcctataaaaatatgacgctatccaatgctgataccttagaaagtgactggcctgaaggacttgatgcacaagggattgatcaacctttatgtcgttttgatgctgtggtggcaaatccgccgtattccgccaagtgggacaatcacgagcgtaaattaaaagatgcccgttttcaaccttttggtgcgttggcacctgcttcaaaagccgattatgcctttattttgcatagtctatatcacttaggcgagcatggcacgatggcgattgtattgccgcatggtgtacttttccgtggtgcggcagaaggtaaaatccgtaaggcattgattggcgataacaccagcaatgcacaaggaaactatttagacgcagtgattggtttgccagcgaatttattctacggcacaagtatcccaaccacgattttggtttttaaaaagaatcgtaaaaataaagatattttatttattgatgccagccaagattttgacaagggcaaaaatcaaaaccgcttaacagacgagcatgtccaaaaaattattgacacttaccaagctcgtcaaaatgtggataaatacgcttatgtcgcttctcttgaagaaatcattgagaatgactataacctcaacattcctcgctatgtggacacttttgaagcagaggaggaaatcaatattaacgaggtgttaaaacaacttcagcaagataatcaagaaatcgaacaattagaaaaagaaatcaacgaacagttaaaattattgggagttgaacttccataacaaggaaagagataaaagaggcaaaagcctctttttttataaaattttgcataatgttaccgcacttttgagaaaaaaactcacgcttgggaacagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagaacaacaaaaaatcggtacatttttcaccgcacttgatcgctacatcaccattcatcagcgtaagtaatacatacaaaggagatatattatgaacgaagtaaattcaaataaagagctgttttatcaatactattcacgctggatttatatgtacaaagagggggctattagaaaagtcactatggcaaagtatctaatgacattagagtggctaaaaaaattgattccaaatctcttattgtgtgatcttaatcgcataagttatcaacaattactcaatgattatgcctgttatcacgaaaggcagaccacgatggattttcatcatcaactgaaaggtgcaattcttgatgcggtagatgaagggttattaccaagagatcccacaagaaaagccattatcaaaggtcgcccacctcgtttgaaaaaaacaaaatacttaaatcaatttgaactgcatacattaattacacaattaaatttaaccaaagaaattaactgggattggtttattttattaattgctaaaacagggatgcggttttcagaggctttggcattaacaccaaaagattttgatttttcacatcaaacactgacaattaataaaacttggaattataaagatggtggtggttttcagcctacgaaaaatcgttcatcagtacgaaaaattcctttggattggcaaactattattcaatttgctgagttaattaaaaataagcctgaagaacagcctatttttgttcgtaaaaaaatttttaattccacagtgaataatatcctgattaggcgttgtaaaaaagcaaatatcccaattatttcactacatggtttgcgacatactcatgcgtcattgttgctattcgctggggtatctattgcaagtgttgcaaggcgtttaggacattcaaatatgacgaccacgcaaaaaacatatttgcacattattcaagaattggaaaatcgagatattgatattgtaatgcgttctttatcaaatttaagttaatttagagctacgtcacttacgctgatgaatggtgatgtagcgatcaagtgcggtgaaaaatgtaccgattttttgttgttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgttcccaagcgtgagtttacataaaacaaaaaggctatcaaatgattgtatgataaccttaatgagataacttaaatttttctattttatactataattattttctctgattttccttagtcgcttttacaccacgatagccacagctactaggaattaaaatacctatgcctttcgtttcgacatcttgcgaatcaatgtatttaatattgacttcacctgtcggatttgcttcttgataaaacactttttccccattcagataaatccgcttcttgacaatcaagaaaaaattgctataaagcactctatttttgttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgttcactatgaatatgaacaattaagaagaactatcaccgcagcagcactatttgtgtctaatttttatttagctcatcgacaaggttattttgacttatctgccaatgaaaatcccattttacatatttggtcattagcagttgaagagcaatattatttgtttttccctcttttactggttattgcctataaaaaatttaaaactcatcaagtatttaaacctatagtattgggtttaatgttgctatttattttaacttcatttatccctcaatcaatttatatcaaaatcggttggagtaatacttattacatttctttcatacgttttccggagcttttaatcggatcttatcttgcattaagtaaaccaagagtaaagcctgttaataattttgttggtttcggtatttttattgcacttatcttaacgctattcttttaccataaatcaatgccgttaatgccaggcattgttctactcctaccttgtattttaaccgcacttcttattcatttctcctcccaaaactcatggggggggggggtaaaaactctcttatcattaaagcccatcgtatgggtaggtaagttatcttattctctctatctgtttcattggatttttattgcttttacgtattatatttcaggtgaaaaggaacttcctcaaggtgcaattttaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttccacgcacttgaaaaaagcaagtgccagccgtgagaagctgaaaatgttaaaggcgaatagcacgcctcaagcgtgtttttttattcgtaatttacgcacacctaaaataaatctagcaatagatctattctcaatggtagagcgtaaagggcaaccgcttgcggttggctactttcctttgtacgtagtttctcacccctttacgctttaccgcccgaccgtgagaagtctagcggaaagccttttcaacattacaaaggaaaccgcaaaaatgctttataaattcattttattaggagaaaaccgcctaaaactttctatacgtgctaaatctgaagctgaagcacgccaacaactcaacctttctaaaaaccaagccttatttattggtcaaatcaatacaagggggcgttatgtctaatcgcaacctatcaaacgaaatcaccacgcttaaagctgcattaaaaagtttactttcaacttttcaaactagccgagcaaagcgacaagttaaaagcaaaatattcaagctataaaggagatttagacgatgagtaatacaaattatcaagcaaaccaagaaaacgcatttaagcccgatttagagggcattaagaacacattagaaacctcaagagatttaattattcagttaaaagagaaaaagcccgtaatagcttttaatgacgaggggcaagaggttcagttatctcaagaaaaaatactagacatagtactaacgaaattattctgttctattgacgatattgacgaaatacagaccgcacttttaagccttgtagcgattggagatgatagcaaaaacgatagaagaaccctaacaaaaaagccctcaaccaaatggcaagggcacaagtaatttaayttaactcataggaagwaatmaatatggagttctaaaaagaacgtcatggattatagcctaaatgagyttgaaaaggtacagaaacatgacaaaaatcaaattttcagtattgctaaaaaatcaaagtgcggttagtattggcgacactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtctatacgtcgagataaggcggagtttatccgcacgaataaggcgagccgattattagcggtagttgaagccatttcgcaccctattaacaggggcgatacaaatcacttactaactaaataattgagaacaatcaaaatgctattcaaatttatcctattcttaggcaaaaaccgcctaaaactttctatacgtgctaattcagaacaacaagcacgaaatctattaaaccttaaatctaacgctttatttatcgcacgcattaacgacaaagggggtatttatgcgtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgacatcctcccccgcctaaaggcaggggattcctaccagctcccacagcaagctgtgggctactctcggtgggtttctactgctgatctctattgagattcacttcatagacgcttcgggtatgtcctaccctgatatttattatgcttggactattgcttgcccacgtgtgagaacattcattgctcccactacatcggcattttctgtatagccacattctacacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtaaagaaacctatattttcaaggttttcaaaaaggaaaatttataaacaatataccttgtagaatacctctggtatctaacaaactataaaaataaaacttttataatagctaacaatataggtataacaaaccaaattccataatataaaaaacggataaatctttttattattggttcagtttgttcttgatatataagttcacttgcatatatatcagataaatttttatatatttcaccattatctcccatgactatactttcatcattaaatgattcagcaatttccattaagacttttaatgaaatttcatcaggattagagagccataaactattatcatcataagatataaagaattcatactcatctttataaaaaattcttttttcataatctacggagaagcctaaactcgtcatcttgtttataacccgctcaaaatcatataatatcttatcagtgctaagtttatctgacttatttacaatagatacatgatagcccatattatttttcctgcttatctgtaactgttttataaagttctatctaacaaatcgggttattaccacattcctcaagcatagctttacggttagattcgcttatgcctttatatttctcaaaaatcgctttcggctctttaccttctttctcagcttgagccagttctctaatatcacaatagtattatatttattttgccattctttatttgtttcaatttttcatttcttgctttgtatatatttattattttataaacatatgatccgatatttttttcagacatcaaaaaatctttccatataatagttttaccatcaaaaatatctatataatcccaaagggcatccaagttatttccaaaatattctcctaattctggaacttgcttggataattgcttataaaaatcatctggagaaaaaatttcctttccttcaattattatttccatcttccaacctctttaaatgttttataatgatctgtagtaataaataataaaccgtcacttgaatataataatctcgttcctagttgtttatttctacctatattgttattaataccaatatcagcctcataccaaactcttccatctttactaggtaataagttactttcgtttctaaaaatatccccaccaatttgcccttgttttaaaggtttgccacttgaccaattatataatttttagctatatccttagttacatactcatcaggtaattttccagtttttttcaaactatcaatgactagagcagtattttgttctgcttgtaaatctaattttaatttaggatacaacgctacattctcagccccgcttgatacccttagcttagcatcctgcttctcgtaaccttttggtggtgtaacaataggctgtctagtcagatatccttttatttcccttaaagataaagaaccaccacctacagccgccccagcttcaatagccatgctggcataatgaacactacttggcaaggctgcatagctgtttgcattctcatctcctacaaaggtcgccattttacctttaaggctattacttaatccatttacataagatatcactctcaacgcagaaaggtttttataaacttcatcattccctgttcccatttgataaatatggggaagataacaaatcgggttattaccacattcctcaagcatagctttacggttagattcgcttatgcttttatatttctcaaaaatcgctttcggctctttaccttctttctcagcttgagccagctctctaatcagcttttctacctcatagttattgagatagttattctccaccgcacttttcccaatctctccactcaatgctgcattttgtacggtgttcaccgtgctatttgattgattgttttatcgggattgtaagaaaaaatatccaaatctatattttcatctgtaaatatcttagagattatatatttaaatctctcatatctgtcatagatgtcagaattatatttagttaaaagggtaaaactatcccaatttggaattatcaataattcaattattcgcataatcccaattaaaatatcttgttttatcaattttgtgtttttataggttattgctatatttatcaaatctttttctagtttccaatattcatcatcattccattctgagtaatccaaccatcttcctataaatgaattttcatcatataaccttgaataggttacatttctataaaaatctgcgtattctgccatgtttaatctccaattttatttaagttaatatcaaaagttccgtttcttgtttcttttttatttaatttttcaggactagccgcttctttccaagctcctccattatgaccatccacatctctagttatatagctattaccttttttaaacacaactgcaccagacttatcatcaaattttgttcactgactttttaaagtttgacgttttccttggttgtcaattgttttcaactctaatcccatcagctaattctaggtctaattccatatctatgatcaaatttataataattttttttgcatcattcgtaattgaaatttctctctcatataactgagtacagatcaactcaagagctataccatactcatcataattaattaaatccattgcattctcacaatcctcttcaggcaaatttttataaagcaaagatagtagatttttcattttttctttcattatattactcctgtttaatagggaatgcggtaattacaccatttcccattggttctacaataaccctaattctaacgccatcaacaactccctcaactttaaatctactcggaacaccctttttagtatacaaacttccttttgttcctgtttgttgtacccattctaaattaggatcagtagcaatattagatataacgtcgagaatttttttctcagaccagtgtattgggaatttagattttccattcagaatatttgtaaaagaaaatttatgcccaccacctgttttatctccatataatatatgttcagctctctgagaactgactagagataccatattttctctagcagttattagattagagacatttttagtaacaactttttgaaatacatttatagcttcacccgtcaataaaatactcggtgcttccaacgatttacccagactaagcatatagccttgcatttctgcggctaacatagagtcgttttctaaagcccaatttaactgctcattccattgttccgctgaaatcaccactttatcaaaggtctctttcgggttttggattacattcgccagtgttgcaacggttttatcaagatttactatcccatcaactgtgccttgtacaccttctacaaccgctttagcttccccaattttcattgcatcataataagcttccgctaattcctccgcattttctttatctttgaaaagcgttttggcaaacatttctatcgattgcttacgttcttctgatgggtgaatgtcatcaccaagaaaattaaactccaccgcattctcagccaccctcattcccgtactcactgtcgccaatgtaccggctgcggtatcactgcctgcagctacaccacctgccacacctgcaatccctttgataacctgaataagttcttgcttttccatttccgtcagttctgttggggatttgccatagacggtttcgcttaagattttcgcacccacttcacccacgcctgtagccactgcacctgccgtcgcactactgcttgataactgggcttccattactccccataaaatatgagcaggaatatttaaggcttgtaactcagggctgtctgtcactttcttaatcgcttcattcacataaggcgatacggcacctgctacaaccgcttctgtcggtttccctgcaacaataaggcttaatgccgcagcgactgcggttgccgcctgtttcttgttaccacccgtttgccattcttttgcagcttgttggtaagcggtagcttcttgggctttttgggttgcagtaacaaggtcgccttcttcagccgctttcgttgcctcttgctctgcttgttttgctttttcctccagttccgctgcttgccggctggcataggtcatcaccgcacctgcaacattgcctgcctcttgtgaaaggatttgttgttctttcaacaccttattaatgtctttcggtgcttcaacctgtttattcgccttatcaagttcggtattaatccccaacgcttttgctgtggtttggattggatttgtgtctttgtttaaggtgatttccccctcggtgatagtggttttggtgattgagctgtcattactttgactatgcatcggtaagctcggggttatgttcggagcggtttttccttcaaccaacatcgcattttctgctcctttgccgtaagtgcctgagattgaaacacttgttgccttatgacttgatttatttcgaatgtcattaaaagtaaggcgattggttcgcagttcactgttgtttggggtagttgaagcaatggtgccgcctttcaagtggatgttgtttgcttctatatgataaccgcctttgcctgcaattaaacctgcctgttcattaacttgtttataactgcttttgcctttctcacctgaagcaaaaccactcacactccaagcattaccaaaactcacatctacactaatccctgcctgactgcctttgctgttgtaattgttgctgtcttgcttgctttcaatccgaaggtcgcctttagcattcacatcaattcgctcagcagtagcggttgtgccgttgagggtaatgttcccttgactgttaaacttaatatgttctgcatctaaatgactgttatggtaagtggaactttcatacctacttccacaccaacgttctgtcctcagatttccatttactcccctttggatttattttttatccttactctttcctcccatatgtctagaggaacgaaatattcattctcagcctcttcttttgtgagatcacttattcctttcatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacaccgcctgcaaccgctcctgcaattgaacctaaagtgataatatgttgccgttcttctgctgtcaattggctcgcttcggttttgttgtacagcaatttagccaaccttggagctgccagctctgctgttgccgccgaaactgcacctgctgcagcattgccttttaacgctgttgcttcaattgctccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtccctatcgcccccgcactttgattcgctaatacaccggttaaaacagtggtcaataccttggctgttctgttgtatgtgccattgttatcccattgcttttgggattgtgtcgctttaataagtgcggtcagttttgcttcgatttctgatgagcttgcattcggattcgcttgcacttgttctaaggcttttttcgcctctttcactttctgtgtagcttccgcttgtttatttgccgtgtaggtttgcactgccgaactaatatgccccaccgcctgaacaatctccttttgctccgccagtagttttttcacctcttttggttttgccacttggctgtttgcttggctaaggtcggtattaaatcccaacgcttttgctgtggtttkgattggrtttgtgtctttgtttaaggtgatttccccctcggtgatagtggttttggtgattgagctgtcattactttgactatgcatcggtaagctcggggttatgttcggagcggtttttccttcaaccaacatcgcattttctgctccttttttgctcagtttgccggtttcactatcttggtagtaatctgctcctttaccgtaagtgcctgagattgaaacacttgttgccttatgacttgatttatttcgaatgtcattaaaagtgaggcgattggttcgcagttcactgttgtttggggtagttgaagcaatggtactgcctttcaagtggatgttgtttgcctctatatgataaccgcctttgcctgcaattaaacctgcctgttcattaacttgtttataactgtttttgcctttctcacccgaagcaaaaccactcacgctccaagcattaccaaaactcacatctacactaatccctgcctgactacctttgctgttgtaattgttgatgtcttgcttgctttcaatccgaaggtcgcctttagcattcacatcaattcgctcagcagtagcggttgtgccgttgagggtaatgttcccttgactgttaaacttaatatgttctgcatctaaatgactgttatggtaagtggaactttcatacctacttccacaccaacgttctgtcctcagatttccatttactcccctttggatttattttttatccttactctttcctcccatatgtctagaggaacgaaatattcattctcagcctcttcttttgtgagatcacttattcctttcaaatataacattggccaactgtctgcttcttctatatatgcaaatttaacatcgaatgtaccatcattatttaaaacaaatctactttgagtccaatcactaccatttaccttcatttccgattttaaattttcataaagctctaatatatttcttttttcatgaggaatacaacctacagaataattgcattcatccccggcattatttatccaatacattctaaagcttgatatcgtttcatgaaattcacattcaaatatatacttatcagcttctgttggcattagcttccatatttcattagctattttaaaaaataaattgttacactttttgcaattcatactattctccagttggagtgttttttatcttaggaagttcaatgacttttccatttatagagtagttaatatcaaaagaatcaggtcttttactattccctctatatattggtttaatatcaacctccactttcttaccttgctctaaagcttgcttccattgcctttccatctgataccattttcctttcggtccattcaatatctcatccattgctacaagatttattttctctcctgcacctctaaacattgatgccagtaaatgtcctccgcaatcgctttctaaacgacattcccctccggttatggcttgtttagatttattctttatttttaaaaagtttattatttataaaagtttttaaaattagtgccaaatacaaccaaaaagacccccaaaatatatcactaaatgcatcattagcccaataaaaatcatcatatttaagataaatataaatcatgaaaaacacatgttttaacgaacaaaaagagacgataaaaaaataccaaattagccaataaaaaaaactattttttttcattaggtatctcctttttcaaaaatagaaacatcatctaagacgtcttctatagttcccttaagaacatctttatgtttcataattttgattttttcaattaactctccttgattaatattacgaaaaactctagctatatgagctatagataacaatgataccttttcaagttcaacatctccggatgataaaaaagaaaataatatttcttttgttttagaaggttcatcagtatacatacctaacgacaagattactttatgtttaatattattctcaacttcagaagaatttaatattaccattccatctttaaaattaatcttgtctaaagattcatatattaatttactcattttattttcctttatcatgagtataatcaaaaatatttatatgcattcctatttttggatcataatctaatcgctaacttttttcatttgatgatatgcgaccaataacctttccatacccatcactgatttctaaatttcatattatcttccttcacttaaagatgtttcacagcatcatgaatatttttaggtaataattgcatattattagggctactttgagcattatgatgccatgtataacattattaggataatatttgatagcaagccacttgatactcaacattactagtcttatatttttcgataagatttctacctcccaaattcagaacttgagcttcatttaacacatatgaacaacaagcaaattcatcatcatcatcaggattaatatacaaaattgttatattttcaggtaattgaatgaatagagaatccaacagttcatccgtatcattactatatacctctatatatctctctaatttcgtcatggttctatccttctagtaggatctgcactcttagtttgctttcctgttttataattaaattcaccaaggtgttttcctttatgattatatttctctaatgtgccatgctgagaatcccattcataaatatatccttctctatctttccatctatttcgtagttttcctccaccttgtatcgaagttttacgctttacctcagttaaacctgtaattcctgtaatttcatcttttctaggtgcagggatatatttccaatcattaggattttttgcttttttagcaaaatttgcttgtgaactagactgatttaaagcctcttctttagcaagcaaatgagctacaccaagggctaattcagcccctttttctaaagcactttgttgagctttcaagacttcaatagttttcgtattttcttcttcaactaattgatagaatttactctgttcttcaaaaggcaatccttgaatccagctattcaatgctcccgataattcatctgcaagaccaacagctttcaataattcatttggtactgttactctacattcaatctcacaattagcgaacaattccgctcgttgtttttcacttaactccctgaatttcttatgaacttcatcaacactttcaccattttgaatagctgcttttaatgctttttgatattgataaacatctttaagagaaagggcgttaaactccactgcactttycccaatctckccaccyaatgccgcattttgcaatgtatttgctgtagtgttcgattgtttgtttgcctgtgaagtaacaccacctgcaaccgcccctgcaattgaacttaaagtgataatatgttgccgttcttctgctgtcaattggctcacttcggttttgttgtacagcaatttagccaaccttggagctgccagctctgctgttgctgctgaaactgcacctgctgcggcattgccatctgcaactgttgcttcaattgctccccaagtggcgtgagccaagatattaagtggcagattaacatcaccattttcatcggttgttgcctgttttatcaggttattaaccgttggaccggcaagttttgtccctatcgcccccgcactttgattcgctaatacaccggttaaaacagtggtcaataccttggctgttytgttgtatgtgccattgttatcccattgcttttgggattgtgtcgctttaataagtgcggtcagttttgcttcratttctgatgarcttgcattcggattcscttgcacttgttctaaggatttttctgccaagtaagaataggctttatttaatattaaatttatttgatattattttttttatacataatcctataaataaaggaattgcaaaagataaaatatcacttaaagcatcttcagcccaataaaaatcaccaaatttccaatagatatatataaatatccctatatgctttaatgccgcagcagaaaatactgccaaaaataatgcaattaaataaattatcgtcttgatcattttgacaactccttgttattaaggtatttctttactttttcataatcttttactctattatcaaaatctcctccatactctccaaaagcaccgccaagaatatttccaaaggtagaatctttaaggctaaatggcttatttattataggagaaactattgcactgaaataatcgctgcctaaggtatttccactaggatcttttgataagctggttactgttgcaatacctatattaatcctaatttgattacccaatgatcgatttctggttaaagcacctcctgaaaatgcacctaacgcatcataaggattaatatcttgccctgtaactgttttatatcctacatgagctccaagcgaaatacctccatcaatcaacattccagtggtgttaggatatttagtcgaaaattctcctattacacttgcagttgtttttgccgcagatgaagctcctttagctattttaccaacgtattggacaccttttacagccgcactatgtgctcctgttcccacaaatgaaagccctgttgcaagagagttgctcaaacgtccttcaaaactttccgaatagctatatactctttgagctcttaattttaaatcagaataatccagttttatttgtggtgaatctattggtgtattcaataatctcatttgagctggtacatcgctatattcccttacccacttaaacaggatttctctatctttttgagtaagggtatcaggactggtttggtaggtatgtaataacttgtctgaaacctgatctttctttaataaatattggattagtattgcttcttcaggagttaatatttttttctctactaatctatttaatttagcatattcatgctgtgacaagaaattatttttcaccgcactttttgctgtctctgctcctaatatcgttgatgaagtattgccacccgttacattgccgacaatcaaaccacttagctgtgaagccactttgaggagtgtccgttcttcattgtttaattgctctgccgatttattgaaaaccacatccgagaggaacattgccgtagtctcacctgccacaccggcagtcgctccgacaagggcatttgtacctgatagatgtgcttcagtrgcagaaagtaaagcgtgagctaacaaattagccattttactgtcttttgtcattgtgtgaatttgtgcattcagctcmggrgaaatcgcarcarcgacaacttgcccagcastgccaccacttaaaattgcccctaccgtagcaacgacagcatcaagtttacgtmtttttgaaccgccctcttgccattccacatmttgtgtttcttttgccttgttrttggcataaacattggctgcttgactaatatrccccactgcmcgagcaatctccttttgctccgccagtrgttttttcacckctttyggttttgccacttggctgttygmttggctwarrtcggtrytaatmsccaacgcttttgctgtggtttggattggatttgtgtctttgtttaargtgattttcccttccgtaagcgtcgctttggtaacggaactgtcwctgccttgrctrtgcatcggyaagctcggggttaygttcggagcggttttgccgtaagtgcctgagattgaaacacttgttgccttatgacttgatttatttcgaatgtcattaaaagtraggcgattggttcgcagttcactgttgtttggggtagttgaagcaatggtrcygcctttcaagtggatgttgtttgcttctatatgataaccgcctttgcctgcaattaaacctgcctgttcattmacttgtttataactgcttttgcctttytcacccgaagcaaaaccactcacactccaagcattaccaaaactcacatctacactaatccctgcctgactgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatataccccactgcccgagcaatctccttttgctccgccagtagttttttcacctcttttggttttgccacttggctgtttgcttggctaaggtcggtrytaawtsccaacgcttttgctgtggtttkgattggrtttgtgtctttgtttaargtgattttcccttccgtaagcgtcgctttggtaacggaactgtcwatgccttgrctrtgcatcggyaagctcggggttatgttcggagcggtttttccttcaaccaacatcgcattttctgctccttttttgctcagtttgccggtttcactatcttggtagtaatctgctcctttaccgtaagtgcctgagattgaaacacttgttgccttatgacttgatttatttcgaatgtcattaaaagtgaggcgattggttcgcagttcactgttgtttggggtagttgaagcaatggtactgcctttcaagtggatgttgtttgcctctatatgataaccgcctttgcctgcaattaaacctgcctgttcattmacttgtttataactgyttttgcctttytcacccgaagcaaaaccactcacactccaagcattaccaaaactcacatctacactaatccctgcctgactgcctttgctgttgtaattgttgctgtcttgcttgctttcaatccgaaggtcgcctttagcattcacatcaattcgctcagcagtagcggttgtgccgttgagggtaatatccccttggctgttaaacttaatatgttctgcatctaaatggctgttatggtaagtggaactttctccgttggctttttgactaccgccaccgacagtagcataaacccctacacccgtttgtgctcctgcttgagcaaacatacctacttccacgcccacattttgcccacgggatttttccttggttcgactttcgcctgcttctatttctatcttgtttgcatttagctcaatccgactgttttcaaggcggttgccgtctttgtcttttgacacaatatcagcatgctcaaggcggatattacctgtaccgctttggttgtgatttgccattgattcagttgataaagtgcggtcggttttgttactgttttgtgcgttgctttctgtgttatcacctcgagctgttagcaccacttctttgccatttaacacattcccttgactaagatgagcttcactttcctgtaattggcgactgtgagcgacacctgtgccactttctactcgtatcaaataaccggtattcggcgttttattggcaattttataaatgctgtcggctaatgtataaccctgagccgccaaacctaaggcttgtgcagtctgaagccttgtagaggcctctttgttttttaccacccgttcaactgtttggataatatcaataatcggcgatttgatgcgattaaattgtccgattttcaaatcactttgactttgttgttgtgtttgctcattatgagctgccactgcttcaatattctctgcggtaatatgcagtttgtttttcgacagtatttgacttgaggtttgatgataatccttgcctgcattgatttccacattaccattaagactgacaacttgactgccttgatgacggagactatcaccagcttgattaaaccgctcacgatgataaccaaagaaacgctctgtttctgatgtcgccacctcaccaatggcgtgattttttctcgcttggcgttgagtttgtgtggtagtcgccgtcgtaaaaagaatatcacctgtcgcactgaagctgttattgccttcacttaccaacactaaacctttacctatgatgtcgccctgttgagcagtggtttggctgtttccgcccacggaaatcaccgtgcctttttcctcaatcaacgattgcttgccgttttcacgccctttgccaacacctgctatatatttatttaacccgttaagctcaaatcccttactggaactgttcgccgattggctataacggttgatggctacatcaaaatgaacatcgccggttgccgtaaaggtcgcatctttttccacagataaagttgcaccttgggtgatgatatcgccaccggtagcgactaccgttaaattgccttgcgtgtctatgtttgcactttgagcaatcacctgttcagtttgtttgttggattgatgactttggtgcttgatgtaaggctgaatacctcgcattatcataccggtagtatccgtaatagcctctgctcgtgaaagctcatcaccaacaattccatttgtaacaccttgatctcgacgttgtttgtatttttcttttcccacctcaatcgggttatacaccatattcacaccaaccccaccggatttgctgacatagcgactttgcccaaggtgatgctcttccaccgcattgatatttaccttactaccttgaagatgcgtatcgctaccactatggatttcagtagcattcaaggttaattgatgttgagccgttactcagatattgccttttgcattcagttgtgttgcaaccagctcctcattgtgacttcgattatttgattcagttttattgcgttgatagcccaccgacacaacaccattcgaaagactaccactcaaaccgctttttttggctttctccctatagtccgtcatttttgtattgatgagtacattcaaatcaatgtcttttgcagtaatatcaatatgttgtttcgcatttatatcggtagcttcggtttttaatttatcacctgccacaagtacaatactgtcaccttttaacaagctaccctgatagttatcttgctgttcgttatagtgcgtttctttacttttcttagaaatagcattaccgcttttatagcgatgctgttcctcaagtgttgatactgttttcattgccccaaataccatctcatttgttgcaagtgcggtcagttttttcgctgtttcaatcgccgtactttgcgtgtaaagattatcggtttctaggcggatattgctgttgctttgtatccggctaataatgaggttttgattggtttcttgacggcggtggtcgcctgtccctagtttttcactgtgttgggtagaaagtgcggtgctttttaggctgtttttaatattaagcaggctgtcacctgtgccactgttaataatatcactgccgatttggttaagattgtcggcgttgatatataatgtgccgtcttcgcctttcacgtggagtaatgccttacggtcaaggtgcatgtttttataatggtacccataacttggattgctactttcatcggttttcgtggttgagcggtgtgaaaatgtgccacttacattcaaggctaatctgctttgtgcttcaatgtgtccgccttcattagttaaatcccctgatgtctgaacataaagtcgttgggcggataaggtaccttgattatgcaagctatcgccatttaactgcatcacttcccgtccgaaaatcctgccttggttaatcagttcgctgttttttgcataaatgttattcgctgaaatcaggctgccttttgtggttaatggtgaaaaatctgctttgttcgctacaagatagactttcggtaccaatacttcttgttgacttccattaggtagtgtcactgtttcagtttccagccacacaatatcggaagtcaaccttgccctttgtgctttactcagtttcacgccaggtcggagggtaaattcattcgctagagtttggctgaatttaactgccgaatccattaaggcttgatattgcacttcaaaatcttgctgatgccttgaagggagtttaccggttaattgataaagttgttctcgcacaaggcgttgttcatagtagccgtcgcctaaacgtttttgtacttgatttgagtcataacgaagagcattaaacatataatcactacttaaccatttacgataattggtaaaggctggggtggtttccactaaaatatgactgtccgcttgcggattgatttgataaagagaagaactcggtagtattgttgtcccttgtgtaaaacgaatttcacccttgccgtctgttattttaataaatggagctgtagtttgagaattgctttgtgctgtcgtagcaacggcataatccccttgagtttgactaaataccacatttaatggaatagtcacattatccacggtatggcggtcatgtcgtcctccccatttgcgttggaaatagcgtttgaaccctcctcgccattttgaccaagtaaattcgtgattaccgaattcttccgtagaatgaatgccttcttcatcagtgtttttaaacggactattttcatcttgacttactaaatttccaccggacagtattagcgaacggtcattatgcaccgcaccttgaaaccacatatcgccaccagccaatattttacccggtgcggtttgtttcaccaccgtttggctgattttgcgacggttgaggttaatgtcccaaaagcgatcatagattttgttggaaaaggcggcgttgtgcttttcaattgctttttctaattgctcaaattgtgtctcattggctttcaaccaatctaaataaggtttcagttgtaatgaaagtgcggtctgttttgcctgatattttgacttgtttgcctcataatctgctttttcggtttcatagctttgtaggcgtttagcaaaatccgcttctgactcattattttctcgagaaggtttttcgggttcattgggaatgtcaaaataagcttgtaacagatttacatcaggataatctttgaggttcaaatgtacttttttatctaaatgaatattaaaatgtgaccaagccccgtcattaggtagatacaaagaatgcggtttaatttgacaatttttcttaccagcaagattgctgcaactttcttcattcggcatcggtaagatataaccgttaaagttgccattggtttctctctcttttaactcagttgctcgagatgctactttaccggctcgactaaaagatatccaacgcaaggtgttaaaatcaattttggcagaattaggttgtccttcaggtaataaataatgttcatttaattgggtatcactttgtaattcaaacgctgtttttaaatgttcgttactattgattaaggatttcactccaaaataagcattgccagccacatcaatcaacccactttgatttttaaaattatcggcaaaagatgagttttcagaagataactcgacttcctcagttgaattcaaacggcgaccgacaaacaaattaccctgactcaacagacttggaccttccgtgatttgaccgttttgcttttccgctatggtcaaaaattgtttttggtttatcagttcaggtgctgccaaatccaatcgtttatgagcggcaatgacggcagatttaacatcgttgttattgcccgatagttgctcgtctcgattgacaatacgagcaccggcttcaatggcgactttatcgcctaatatttgtcccgtgccaatattttccaccatctccgttgccttgataactgtcttttccgttcctaataccgcccctcggttaatcagagatttttcactttcaatccgattttgtcttcctcgaatcacaccgctcgaagtctgttcgatattctcttttgcttttacctcaaccctctcttctgcatacagcttgcctgcattatctaaagtgcggtcggttttaaggcggttttttgtcgctgctattatttgaccagatgtggtgttcacaatcttgccctgactatcaatcactacctctgagctacttgcaccaatatgccctgcattgcgtaccccaacgccattttctgtaccaataagataaattttgcccgaatacattccgccaagctctgctacatcaagggaaaattgcggttgtgactcgcctgaaacgtgttgggttgtgtgaataatttgcaaagttttgtcggaatcagaccgcttgatactatttttccctgtgataacggttgcttcttttttcgaccaaatccctgcattcacttctgcttctcgagcgaggatttcagtataatccacacgactgttgtccaagcctttgccgctgacattgactttaccggcttgaaccttaaaactctccacttccccgtttttaatctcaggcttgcctgtagaaagcgttactcgaccggaatttatcacaccgcaaccttcacaatgtagccctgaggggttggctataatcacatccgctttgccgcctgctacttccacatagcctttcatcacggatggcgaagaagaattgatctcgtttaaaatcactttcgcctcacctcgggcaagataaggattagccgtcacctgccctgcaagttgggtagaagtgcctgtgcgactgttatttaaaattactcctttctcggcaacatcaaattgtgaatatttattatgggaaagccctttggtattgggcgtttgaatattgacttgcggaagcccgttggtagtttgcaaaacaatgggttgttgggtttttggggcggatttatccgcttgaataattaaagtttcagcaaaagcagaagagaaaaacgaagaaaaagaaacaaactccaatgcacaaaataagctgaaacaaagaggttttaacagagctaaaaccgaagaaaaatcgaccgcactttttgaacaaacagaagacgaacatgaagatttgtcttgggattttgcaagttctgatacaacgattaaacgttgtaaggggttactaaaaataatgcaaaaatgttgtgtgttcataataaattctcctgatttttccgttttgattatcccagcctgccattcggtgtttttgtacttcaatttccgacttatcaatatagttttgcgattgacgtgaccaaagtgcggtggaaattgtggtttttctgtgactgtcacgataaatcaaataaaayaaaacaatgtgcgcttatcggtttcactttcacctgaataaatatagctgttatcaaacgcccattgatggataggatagtaaggcgattcagtataagaaagcaaaagtgattcagtaggagagatatttaggcgaatatcgggtttaggctgtgatttatcatcttttgcctgctgatgttgttgggctatatcgtttaattgagtatcaaatgtattagtgaaagtggtagtggatattacggaagaaattaagcttaaaatgagtgtttgatggcatttcataatatcaaatagaaaattatatagtcattctaagtagaatatagaatttatcattttttgcaaataatgttactcagtatttaggaaaagaagagtatggttgatattttgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaaactccgttttatcttttaaatggatggattttataccgaacacttcattccttttggagttttatgtcaatggggattggaatacatctgtcatctctgaatcaacttagcaaaatgcgatcccaccatatattaagtaaaactattaaattacttggtttgtatgtgaaattacattacatagttttattagttggtgctgatcgctatagtttgcatgatatttcaatgagattaagcagttgttgcaggttccattgagaataaacgtaatttattcattatataattcaataagataccgtaagcaggtacgaagaatagaatactaatgaaaattttaaataaataatctacagaaccgatttcgacccagtgttcagccataaacggatcgttacttgcgtagaaagcaataccaaagaatataaaagtatctgccagcgagccgaataccatagagcaacttggtgcaatccaccaagtttttaatttacgtaaatggttaaatacatacacatctaatagttgcccaaacaggtaagccgcaaaactggcaaacgcaatacggaagacaaatgtgttaaatgatgtaagtacatgtaaaccttgatattggctatcggaaaataatgttgaaacaagatagctgatgattagtgcggggatcataacgacaaaaataatccatcttgcttctctagcaccaaaaactcgcacggttaaatctgtggctaagaaaataaaaggaaaggtgaaagctccccatgtattgtgaaacgaaaaattctccgcaaatcctaacgttgtgagaggaatggtaatttcaaaaggaatttgaacgaggtagttgcttgccgtaatgataaatatatggaagaaactcaagatgattaatgcacgttttttttgttgatcattgaagatcgaagagatgtttttcattttgtgtacctttttgataaataaaattggggttagggaacccaatataaacatgtccaaaattggagacggagaatgatactgaattaagaaaatatttcaactaatatttacaagccaaattgctatttttttgctattctacacgacaatttttatattacatttaatggatcacagtcatgagcgaaccagaaaatcttgcacaaaatcaaccgcacttttccaaagatacaacgcattttggatttcaaactgttgcaaaatcagagaaacaaaaattagttgccaatgtttttcattccgtagcggcaaaatatgatttgatgaatgatttactttctttcggcattcatcgagtttggaaacgctttactattgattgtagcggagtgagaaaggggcataaagtcctcgatcttgctggtggtacaggggatttttccgcaaagttttctcgtatcgtaggtgaaacgggaaaagtgattttggcggatattaattcttcaatgttggacgttggacgtgaaaaattaagaaatcttggtatcgtgagtaatgttgattatgtgcaagccaatgcggaagaattaccttttgcagataatacgtttgactgtgtgataatcagtttcgggttgcgtaatgtaacagataaagacaaagcattacgttcaatgtttcgggtattaaaaccgggtggacggttgttagtgttagagttttctaaacctattttggatcctttaagtaagatctatcatttttattcttttaatgtattgccaaaaattggtgaaattgttgtgaatgatagtgacagctatcgttatctggcagaatctatccgtatgcacccgaaacaggacatattaaaagagatgatgataaatgccggttttgaacaagtcggttattataatttaaccgccggtattgtggctttacaccgaggctataaattttaggatagagtatgttgcctgattttaattctttgaaaacacagtttatgttaccgcagtttattaatgcgggatgtgaactgttattaaattatcttttgcgacggacaagtcatcgtgaaagatacttgcgtcaattacaaggtaagatcttaaagctgacattacaaaaaacacatttttctttgtatttcgttttttcagcacagcaagtggatttattgaaccattatgaaggtgaggcggattgtacagtggatattgcggtaaatttattattgcaaatgccgaaaaaatcggaaataagtcgatttattaatgataattcgcttcaatttagcggggatttgcagatattacaagattttgtggaattaatggaaatgttggaaaaagatccggcagagctgatttctccttacgttggtgatgtgattgcacatagtgcggtcagttttcttaaaaatttaacagaatcaataaagtatcagcttacgcaaagtcagcaattttgggcggagtgtttgacagaagagtggacagtactttcgcccaaattggctgtaatggatttttgcgatcaagtggaaagtttagcaaaacagaccgcacttttagaacaaaaaattaatcagattttagcatgatgaaacttaatgatattaaacgtttatataaaatagtacgtgtttttttatcttatggcattgatgaaattttaccgcataataaatatactcgttcaattcgttgttggcgaatgttatttttttggttaaaaaataaacataaaaataaagcttttggattacgtttgcgtttggctttacaagagttaggaccagtttggataaagttggggcaaatgttatcgacacgtcgtgatttatttcctgcggaaattgctgatgaattggctttattacaagataacgttgaggctttttcaggaaagattgctcgtcagcaaatagaacaagctttgggttcttctctagaaaattggtttacagattttgatgaaaatgcacttgcttccgcatctattgcacaagttcatactgcaaaacttaaattgggcgaggaacaggaaaaggaagtggtcatcaaggtgttgcgtccaaatattcagccacaaattgaggcggatttaagttggatgtataaattagccggtttactgcccaaattatttcgtgaggggtatcgtttaagagcggtcgaagttattcaagaatatgaaaaaactttgcgtgatgagcttgatttacgtgtcgaaatggcgaatgcaataaagttgcgagaaaattttcttgatagtccgatgttatatattccaaaaatgtatgaagcattttgtcataaaaatgtgattgtgatggagcgtatttacggcattcctgtttccgatgttgagacattacaacgaaacggcactgatatgaagctattggcggaaagaggtgtacaagttttttttacgcaagtatttcgtgatagtttttttcatgcagatatgcacccaggcaatatttttgtgaatccgcttcgtcctgaaaatccgcaatatattggtattgactgtggcattgtggggaaattaaatgagagtgataaacgctatttagccgaaagttttgtggcattttttaatcgtgattatcgtcgggttgcacaaatgcacgtagatgccggctggaccccacaagatacgaatattgatgatttcgaacaagcatttcgagaggtatgtgaaccgattttcgccaagcctttatctgaaatttcatttgcacaagttttactgaatttatttaatgtagcacgtgaatttaatatgcaagttcaaccgcagttagtgttattgcaaaaaacgttactttatattgaaggattagggcgtcaactttatcctcaattagatttatgggatacagcaaaaccctttttgcaaaattggttgaacgagcaaataggtatgaaggcaacatttaaaaagttgaaagccgaattgccttatttgcaggagcatctacctgattttcctgaaactttaatggacgccttgaaacaacaaaaatttattagtcagcaattagtggaaattaacaagaagttagctaaacaacaacgttggcaaaagaaaatgtttgtattaattgtgggaatagtgattttttctgtaacgttatggcaattcgctgcattgccgttggcgataagtgcggggttattcttagttggttttttagtttggctaatcggttttttgttaccttaatgcgttagatcaaaaataatccagtttagctattgtcactatgatttaaaatggttatattctgcaagattttttattaagtttaatgtcataggagaaataaaatgggattaagttggcaacaattactaattttgcttttagttgttgtggttattttcggtactaaaaaattaagaaatattggttcagatcttggcggtgcggtaaaagacttcaagaaagcaatgaatgatgatcaacctaaagatgccgaatttaaaaaaatttccgaagaggtagagcaaacttcagtcgaaaattcaaaacaaaaagagcaggcgtaatctgtgtttgatattggtttctccgaacttgttttacttttcgttgtgggcttgatagtactgggaccacagcgtttgcctgtagctgttcgtacggtaatgggttgggtaaggactgtgcgaagcttagcgacaaatgtacaaaatgaacttagtcaggaattaaaactgaaagagttacaagaaagcattaaaaaagctgaagatctcaatatttcccaattatctccggaacttagtgaaaccgtagaagaattacgtcaatcagcacaaaaaattaaaatgaatttagaggagaaagctgctgaaacaaattcttctgttgaagagcaagtgcaagaactgaaaagtgcggtgcaaaattcacagggtactgcaacgaccgaaatagaaaaaaatcttgattttccttccggtgagttatctcctgctgaacttgcagagttagcggaagagggagaacctatgttggaacttactgaatctgatttttcagaaaaggagccaacgactatctcgtctaatgaagtgattgaaaatagtaaagaaaaagtatgagtgtcgaaaagtctcagccattaattaaccatttattagaactgcgtgatagattattacgcagtatcatttttgtagtcgtaatatttctcgccttagtttatttcgcaaatgatatttataattttgttgcctcgcctttattagatgtattgcctgccggtgcgacaatgattgcgacgaatattgcgacacctttctttactccgattaagttaaccgcagtagttgctttatttatttcagtgccttttctgttatatcaagtttgggcatttgttgctcctgccttgtatcaacatgaaaagcggttggtatatcctttgctgttttccagcacattgttgttttatctcggcgtagcctttgcttattatgtggtatttccattggtatttgcttttttgactaagaccgcaccggaaggcgttgctatcgctacggatattagtagttatttggattttgttttagccctattcttggcctttgggatatgttttgaagtgccggtagccattgttttattatgctggagcggtgtgactacgccggatgacttaagaaaaaaaagaccttacattattgttgccgcattttttattggtatgctactaacgcctcctgatgcgatttctcaaacattgttggctttgccgatgtgtttattatttgagataggtgttatttgtgcgggtttttatcagccaaaagatgaacaggaaaaatcataaaaatgatttgaatttgagtgaataagattaaattattcgctctggtttgtagaaaggattggaaaatgactaaacaaatatttaccggatatcctcaacgccgtttacgtcgtatgcgtaagcaggattttagtcgtcgtttgatgtcggaaaataagctgacagtagatgacttgatttatcctgtgtttattattgagggagaaaatcatcgtgagtcggtgccttctatgcccaatgtggagaggttaacgctcgatcaacttttacttgaagcggaattgatggtgaaatacggtgtgcctgttattgcattgtttcctgtcattgaacaagagaaaaaatccttaatggcggaagaggcttataatcaagacggcttagttcaacgagcggtaaaagcattaaaagcaaatttccctgaattaggtgtactgactgatgtggctttagatccttatactgttcatggacaagatgggattattgatgaatatggatatgtactcaatgatgtaacttctgatgtacttataaaacaagccctttctcatgctcaagcaggggcggatattgttgcccctagcgatatgatggacggtagaattggtagaattcgtaccgcacttgaaaagcaaggctttgttaatacactcattatggcttattctgctaagtatgcctcaaattattacggaccatttcgtgatgctgtcggatctgcatcaaacttaaaagggggcgacaaaaaaacctatcaactggatcctgctaattctaatgagggattacaagaggttgctcttgatattgaagaaggtgcggatatggttatggttaaaccgggtatgccttatttggatatggtttatcgagttaaagatcaatttggcgtgccgacttttgcttatcaagtatctggcgaatacgctatgcacatggcagctattcaaaatggttggctaaaagaaaaagaatgtattatggagagtttactttgctttaaacgagcaggtgcggacggaattctaacttattttgctaaacaggtagcggaatggttgtatttagacgaaaagaataaataatttaaaatagattttactttaacccacttcgtgttagcgaagtgggttttgtttatctacaattgtatgtctaatttatcataggctcgagaaactttttctaacgccttatcaacagaaatatcacgtgcaagaataacacctaaacgacgatgtccattgacttcgcctttgccgaataagcgaatattagtattaggttcttgtaatacttcgaataaattaccaaattgtacttggttagatttgccttcaacgacaatcgcttttgaggcagcggggctaattaaattaatttcaggaattggtaatcctaatatggctcttgcatgaagtgcaaattcagaaagctcttgcgagattaacgtaaccattcctgtatcatgagggcgaggagatacttcattgaaaatcacttcatctccacagacaaacatttctacgccaaaaatgccacgtccgccgagttccgtagtaattttctcagcaatatgttgagccttggcgagtgcttgtacagacattgcttgcggttgccaagactcacgatagtcccctttttcttgacgatgtccgataggtgctagaaatgaagttccttctgcatggcgtacagttaataaagtaatctcataatcaaatttaacgaaaccttcaacgatcacacgaccggctcccgctcttcccccttgttgtgcatagtcccatgctttttgtaggtcgtctttgctttttaagatactctgaccatgtccagaagaagacataatcggtttgatcacacaaggaatgccaaggttttcgaccgcactttgaaagtcatcaaaattatctacaaattgataatttgatgttggcaactttaatttttctgctgcaaggcgacgaataccttcacggttcatcgttaattgtgtagctttagcagttggaacaacattaaagccggcttgctccaattcaactagtgttgaggttgcgattgcttcgacttccggcacgatataatccggtttttctttttcaattaatgctttcaaagcatctccatctaacattgaaatagtgtaagagcggtgtgcaacttgttgtgccggtgcattttcatagcgatctaccgcaatcacttctacaccaagacgttgtaattctataacgacttctttgcctagttcacctgaaccaagaagcatgacttttgttgctttaggtgttaaagctgttcctaatattgtcattttttgtccttttacattgtgttttttattaaaataagatttaagaattgagtaaattatcatctaaaagtagatcttcatttttattaatacctacgcctcgattaagaatattccgtgcaatattatgtgcatcttccaatgaatgttcagtataggttccacattgatattcgtttagttcaggaatttcggcttgatttttgacgtttaaaatatcttgcattgaagctgaccaagcgtttgcaacttgttgttcattcggcatgccaattaatgacatataaaatccggttcgacagcccatgggcgaaatatcaataatttcaatttgttcactatttaagtgatcacgcataaatcctgcaaatagatgttctaaggtatgaattcctttagatgagaggatctctttatttggaatacaaaaacgaagatcaaaaacagtgatattgtcgccttttggtgttcgcattgtttttgcaacacgcacagcaggggcattcattctcgtatgatcaactttaaaactgtcaagtagtggcataatttttcctttagagagcattaaaatagattattgaccggtattgtatttacctagaaattgtattgtaacgtattgctataacaaaaacctgattttttatgatataggtcatgatttttaatttattgtcgataattttaaattttatgtagattttctttattttattgagctttatactttttcttatcctatcaaattaattcgtcttttttttataaaaatagggtagaatagccgatcgaataattcaacataacttcgcaggagaataatcatggtaactcgtagggaattggcaaatgcaatccgttttttaagtatggatgcggtacaaaaagcaaaatctgggcatccgggagctccgatgggaatggcggatattgcggaagtattatggcgtgattttttaaatcataatccgactaatcctcaatgggcaaatcgtgatcgttttgtgttatctaacggtcatggctcaatgttaatttatagtttactgcatctcaccggttacgatctttctatcgaagatttaaaacaatttcgtcaattacattccaagactccggggcaccctgaatacggttatgcaccaggtattgaaaccacaacgggtccattaggtcaaggcattactaacgctgtaggcatggcgattgcagaaaaaacgttagccgcacaatttaatcgagcaggtcatgacattgttgatcatcatacttacgtttttctaggggatggttgcttaatggagggtatttctcatgaggcttgttcattagccggcacgttaggtctaggtaaattgattgctttttatgatgataataatatttccattgacggtcatgtagatggttggttcactgatgatacacaaaaacgctttgaggcttacggctggcatgttattcctgctgttgatggacataatgcagaacaaattattgaagcaataaaacaagctcaggctgagaaaaataaaccaactttaattatgtgtaagacgattattggctatggttctccaaataagcaaaatactcatgatagccatggggcaccattaggtgatgaagaaatcgctttaactcgtcaagcattaaattggaattacgcaccttttgaaattcctgctgatatttatgcaaaatggaatgctcacgaaaaaggacaagtggcggaaaacgcatggaatgaaaaatttgccgcttatgagaaagcttatcctgaattagcagttgaatttaaacgccgtttaaatggggaattaccggcaaactgggcaacagaaagccaagcctttattgaaaaattacaagcaaatccagccaatattgcaagtcgcaaagcgtcacaaaatgcgattgaagcgtatgcaaaattattaccggaatttttaggcgggtcagctgatttagcggggtcaaacttaacgttatggtctggttcaaaacccattcgtgcgacagaaaatatagatggtaactatattaattatggcgtgcgtgaattcggaatgtctgccattatgaatggtattgcattgcacggcggatttattccttatggtgcaacgttcttaatgtttatggaatatgcacataatgcagtgcgtatggcagccttgatgaaacaacgttcattatttgtttatacacatgactctatcggtttaggagaagacggtccgacgcatcaacctgttgagcaaacaaccgcacttcgcttaattccaaatttagaaacatggcgtccttgtgaccaagtggaatctgcaatcgcatggaaagcggcggttgaacgtcaagatggtccaagtgcattaattttcactcgacaaaatcttgctcaaatgaaccgcacttctgagcaattggaaaacgtgaaacgtggcggttatatcttgcgtgcatgctgtgaaaagggtgattgtccggatttaatcttgatcgccactggttccgaagtggaattagcgatgaaagcagcggaagtgttagatgcggaaggcgtgaaagttcgtgtagtatcaatgccgagtacgaatgtatttgataaacaagatgttgcataccgtgaggcagtattaccaagtgcggtgactaaacgtgttgcaattgaagcgggtatttcagatttctggtacaaatatgttggtaccaacggacgtatcgttggtatgaatagcttcggtgaatcagcaccggcagatcaactgtttaaactctttggcttcactgttgaaaatattgtggcaaaggcaaaagagattttataatcagttaaagtttaattttgtgagcgggtaaatttacccgctctttttcagtattatgtagcagttgtacaaagcttaatttagtatttctgctacattttttcttactctcattacaatttaaaggtaagaaaaaatgaatgccttagaaaagttattatgcgatgacgcttcaagcactaaatttacaaattaaatcaccattttcggcaagttcgctacaatccgattggtttccaaacttacggtaaccacccgtaaaaatagttccatcgggtaacgtgggttttgcatggtttcgatagcccaatcattcgcatcatttacaatgccacttgctttatcgactttcaccgattgacgttcaatcacccattccaatgcaggtttgccgttaaccacatagccgtaagcctcttcggggatattttccagcgtaaattttttgttataaatcactttagttggatcatcttcatttttgcctgtttcaagattcaagcgttttgggtgtttcattttttccacataaaaatcgctatcagcaccgccaacaatcctatcatttgaaatagataaaccgcctgtaaacaatacgccgttatacatcggcacggtttcaaaatttaaatgatagtgagctaattcacgcccagcattagaaaatgcccaaaaatcgaccgcactttttactctaggaatgcgtggcaattgcttactgagattatccgcatatttttcccgataatcttcgctatgtaataacccatagatatagtagaaaatatcttctttttggatatttttttgctcgccgtaaaattcggtgaagtgttttaaggcttcatcggtgatcgccgagcgtctttggtaagtttttggcggaatttgaccgcttgtattttgttctgtcattgtttggttatcctgttttattcgtaaatccacatcggaaaacattgtccgttcgcttgtaattgaacatcgggtatctgatcggtaataatcaccgaaaagcccttgctcgttcccagtcctgttatgcaaatcgccaaattctctactcgtagatccacatcgggaagcattgtgcatcgccgatgagatgcagatcggggatctcgttgctgatgagaattgagaatcccttgttgcctgtaactgtgaggcagatgataatgttgtctgtctgtctgtctgtctgtctgtctgtctgtattttctacgctatcaaacaaatcttttgggaaaccttgaccgcccgaatgttgcatattgagatctgggattacattcgtcattacagcagaaaattcttttcctgaatttcctgaaccgcttaaatagatcatttgatttataacattgggaacaggaaataatttgggtaactgatatggacgatggttaaatgttttatcaaaataaatatgatttttagtataaggtctatacaatccttgtcttattttatctttagagaatctttctttttctcctttacttagcttaggataaagactgctagaccaacttattttagaatcatctttatcagcaaactgtacaggatcaatttctaaatttgtttttctttgaatatttaatctatctatttcattattaaaaaatgtaatagaattattcatattttcagataatctttctttagaaaaattgtaaacccaagcatcacgatttgtctgtaatccagctgaataattttcaaatatagtaggttctttattatttttatcttttgagcctaggaccatataactatcaaaattcggatctcgttgatttagccagtcattaaactgatcgggaataatttcctgccattgttctgtttttgtaattccgttaattgaaccaaattcagcgattttttctaatttttctttttttgatagaaaatcaccaatatcataaaaatgaatattgccatttttttctttatctggatttttaactaaaatagaaatagcaactcctgtcataatatcaaaaacattttgaccttcttttttagccgaaatgccagatttaccacgaatggcacctcttaaatggaaaatataaagatcgctaaattcatcgtgtaaacatttacgtaatccatttgctgcattcgtttctaaaaaaccagcattggtaatgaaaccaattactcctttatcttgaatacgatcacttgcccaacgtatcgctttaatatagctatcataaagtgcatttttatttgttgcagttgaatgtaaagcataggtatttctaattttttcttctaataatggataacttgtgttttcattattatcatttgctgatgtttgcccaactgaatacggcggattgccaataatcacttgaatatccaattccttttgacgtttacggcgttcgctgttttctaccaaaatttgatcgatgagatcttctttttcgtacatttggaaagtatcagttaaacagataccattgaaaggttggtaagcggttggattttcgttattttttgcaagtagcgagtgataaacactttcaatgttaattgccgcaatgtaataagcgagtaagacaatttcattggcgtgaatttcattatatttttgcggtaatttttcaggcggaataatcccgctttgcaataatcgggtaatgaatgttcctgttcccgtaaatgggtctaaaatttgtacacctttatcggcaaggctagcgttaaattcattttgtagcacatcttccaccgagcggataataaaatccactacttgaattggggtgtacacaatacctaatttatcttttaattttttaaatgcttgagcaaagaaattatcatataaatctttgatgatagattgtcgtccttctggacttttgatattgctaatgcgttgctgaataccctcgtagaactcttgtaactgcttggtttctgcattggcgatattttcgccttgtaaaatagtaatagtttcacttaatgctttagacattgggttgtgttcggtgaaattatcgttagcaaataaggcatcaaaaactggtttggtaattaaatgctgagctaacatttcaatcacttcatcatcactaatcgcattatttaaatcatcacgcaattctgccgcaaaggcgttgaaagcggtgatttggcgttgattgttagggttttccaaaatcgctttaatccggtctatatgagtttgagcaatttttgccacatctgccgcccattcttcccagtgcatacgatttccacattttttcacgattttggtaactaatgctcgctcaatttcgccaatttcaaactcaaattcttcttgaattgggaaattagctcccgtgccttttgcaccgatattgtgctgatctcgccccgatttttcatattttttctttttcttgttttgatcttttggctgctttttcaaaatttgcgagatggtagaaatgacttcgattttatctttggctgcaccatcaaactgcattttgttgatcattgcatcaaagcggtcatcgtgagaacgcagagcattaagcacttgccatactactttatagttttcattattatctaaggcttcttctggcgttttcccggcaggaatcactacaggcaaaatgacataacctcgctttttgccttctgctttccgcattacacgccctaccgattgcactacgtcaatttgtgagtttcttgcagttaagaataacacggcatcaagggctggtacgtccacaccttcggataaacagcggacatttgagagaatgcggcaggtgttatattccgtttccgatttcaaccagccgattttgcctgttttttcactagcattcattgagccgtctacgtgttccgcttcacattttagttgtagcgattggttgagatcataaggtaagccctgttcttccaatgatgcaatttcttgttcttgataggcttcaactaccgtcgagaacatctctgcaatcgctttggaactcactttgtgtttattacctctgtaatttttctcaatcacttggcaaaatgctaccgcacgtttcatgggttgataatcatcggcaagatcttcttccacaccatattttgataatgctttccaacagccaacgatttttgccgcatcgtccacttggatttcattaccttctgcattcaaaagattctgcaaacggcggttaatatgcgcctcttcaacggcaagtaccaacactttataatcgactaataagccttttttcactgcggtagaaaagctgattgtaaatagttcttcgccaaaaagtgttttatcgtccattgaataaacttccaccccttcagattttttggcatcttcggtatagatgcgtggggtggcagtcatataaagacgtttttttgcttggatataatcattattgtgaatgcgaacaaatgccgattctcgcgcatcgtcaaaggtatgtcctgtagtgcggtgggcttcatcacaaatgataagatcaaaactatttaagcctaatttttgagcctgatggataacatcaattgagtggtaggtagaaaagatcacggtcattgcttcattggcatttttgcattttataccccgaattaaaccgcttgcatcggttgtggcagggtaggaaagctcgtgtaatttagtttgaactaaatcatcgttagattgtttgccgacatcactatcggaacagaccgcaaagctgtgcagttttacaccgctttcttgtgtccattcagttaaagtttgagaaagtagtgcaagacttggtacgagaaacagtacgcttttcccttgtccagccattgcttcggcaattttgagtgaagaaaaggttttaccagtaccgcaagccataattagcttaccacgatcggcagtttctaaacctcttttaactgcttttagtgcttgaatttggtgttctcttaattcctttttagcacgcaatacaaccggttgttttggcacatatttttgccaatcgatcacgctttcttcaaaattggaacggttgataatattgactggaataagttgatcagcaagggatttttctgcattttcagaccaatggtttgtcgtggtaacaattaaacgatgtgtaaaatcttttttacccgatgcagtgaaaaagctatcaatatcgcttttttgaatgcggtaatcggcagaatagtttttgcattgaatagcggtaaatgtgctatcaaaaccaacagcgactaagtcgatacctgtatcatttttatttgtgccttctggttgatatttttctacccaatcagcaaaggtgagaatttcttgatagagattcgtatattgcggttcgttggtgagatagtgttgagttaaggtttcaaaataagtgcctttttcacgctgggtttgcgaattttcttgcaggcagattaaaagttgagaaaatgctgattgattgattgattgattgattgattgattgattgattgattgattgattgattgattgattgattgattgattgattgattgattgattgattgattagacatcatattttccttttatcattgtatcaacacgctgaatttgatctgataaaggatagcaggttagtttaagttgagctagtaagagcgggtaaatttacccgcttttttttgctttttggttaagtgaagaataaaaactcaaatagaataatcgctattttgtcttaatagcattgagttagctccccctttaatgtaaactattgtcccgtctttatgggaagttgtttgttgtcaaagcaaattctccaacacttattttcataccaaaaacacataggtttaatatggctaccaattatatttttgtaaccggcggcgttgtatcttctttaggaaaaggaattgcagcagcatctttagccgcaattttagaagctcgtggcttaaatgtaactatcatgaaactcgatccttatattaacgtagatcctggaaccatgagtccgacacaacatggtgaagtttttgttactcaagacggtgctgaaacagatcttgatttagggcattatgagcgttttatccgcactaaaatgactaagcgtaataactttacaacagggaaaatttattcagaagttttgcgtaaagaacgtcgtggtgattatttgggtgcaactattcaagttattccgcatattactaatgaaattaaatctcgtgtcattgatggtgcagcaggatatgatgttgccattgttgaagtgggtggaaccgttggtgatattgaatcgttgccatttttagaggcattacgccagttagccgtccaagttgggcgtgaacggactatttttatgcatctaactttggtaccttatattccaactgccggagaggtaaaaaccaaaccgacacaacattccgttaaagagttactctcaattggtattcagcctgatgtattaatttgtcgttcagatcgcatgattccacctaatgagcgtgcgaaaattgctcttttctgtaatgtaccagaaagagcggttatttctttaaaagatgtatcatctatttatcaaattccagctttattaaaatcacaagggttagatgattttatttgccaacgtttccgtcttgattgtcaagaagcggatttatctgaatgggaaaaagtgctttatcaagaagcaaatccgacaggtgaagtcactattggcatggtaggtaagtacacggaattacctgatgcttataaatctgttaatgaagccttgaagcatgcgggattgaccaatcgtttaaccgttaatattaaatacattgattcgcaagatgtagaaacaaaaggcatagatattttaaaagatttggatggtattttaattcccggtggctttggctatcgtggtgtagagggcaaaatcttaacagcacaatatgctcgtgaaaacaacgtaccttatttaggaatttgtttaggtatgcaagtggcgtttattgaatatgcacgtcatgttgccggactaaaaggtgcaaattcttccgaatttgaccgcacttgtgaatatccagtcattgcgttaattactgaatggcaagatgcagaaggtaatgtggaagtgcgttctgatgaaagcgatttaggtgggacaatgcggttaggtgcacagcaatgtcatttagttgcaggaagtttagcacatcaattatacggttcggatattattgaggagcgtcatcgtcatcgttatgaagtgaacaatgttattcgtccgcaagttgagaaagcaggactgaaagtaacaggcttaagtgcggataaaaaattggtagaaattatcgaagtaccaaatcatccttggtttgttgcttgtcaatttcatccggagtttacttcaacaccacgtgatggacatccgctatttgcaggctttgtaaaagccgcaagcgaaaaccggaaaaaataaacgtgcagaaaataaaaatagcttgggaaatccaagctatttttttcttattgatatagttccgacacaaattgaggagagagcaatctttctttttcatggaacaaggttcccatgtagtaagaaccgaacggagtgaaatgatcttgatcgccataaatagatttatttcctacataaactgtatcacctaaatattttgccgcatcaacccatgtaacattcggaatatctttaattagttggaaaatttcattgttgcttgcggtattgtccgccaatttttggatcggatttaaatatttatctaagtcatattttgctaagaatgcatttctaagagcggaacgatttaacgagatattattcgcaaacacatagactttttttgtttttgctagatgtttaaccatcgcttgaaatttttgatcaaaatcagcaattacaaaagaattaggattaaatctcggtacaggtgtaccgcctctttttaactcataaaacatggaaataaaaatgacaggataagattcaattttttgccagtattgcacacaatctttatcctcaaatgacaggcagtcactagtacgtaaaatatctgaacgccaaccttcttttgcaccgacataatttaaaaaatcttctagatgccctgcatgcgaatcacctatggttaaaattttacttggaatattgagaggcaatacttcttgttccgctttctgagcttgtaaagcagaagttttatgctttatatgagaacgtacacttaaattgtagccgatgacaactaatgatgggattaaatataataggaaaaaagactgtttaaaggttaatttagattttctaataggttgttccaataaataataacttaatgccgaacaaataaaagtgagtacgatgattgttgacatcctccccggcctaaaggcaggggattcctaccagctcccacagcaagctgtgggctactctcggtgggtttctactgctgatctctattgagattcacttcatagacgcttcgggtatgtcctaccctgatatttattatgcttggactattgcttgcccacgtgtgagaacattcattgctcccactacatcggcattttctgtatagccacattctacacattcaaaatgagcttgagtttcacggttttcttttgcaatatgcccacaacaagggcaagttcgactagtattctgtgctggaacagcaactaaaaatccgccaagccattgcgttttatagcccagttgtcgtctgaactcaaaccaagactgatctaatatcgcacggtttaaacctgatttctgtttcacgtttttaccgtgttcttccgctgtgccttttgccgatttggacatattcgcaacttgcaaatcttcaacatagatcattgcgtggtttttgctgatttgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttcatttagttttcgtgactaaatatcgcagagaagtttttactaaatttattcttgatgacttaaaagcgatttttgaatccgtctgttcggattttgaagcaaaattagtagaatttgatggcgaagacgatcacgttcatttacttgttgaatatccaccgaaagtggctatatcaaaccttgtgaacagtttaaaaggcgtttcaagcagaatgattagaaagaaaaactatccgagtattcgcaaaaaattatgggggaatcagctttggtctccgtcttattttgcaggtagttgcggtggtgcacctatatctattattcaccaatacattgagcaacaacaaacacctgattagttaggtttgaaacggctacgccgtttgtgccttatatccacgccctaaaggacggggctttacggcactgtatggtaaaaaattgtccgcactttgtaaagtgatctaaatcacatttttttaaaatcattgaaataatcctgttatttgattgattttggtctgtagtgattgctgttaggctctttcgcatactcataaacgacaatagggcttttgtgaattgtgatagattgatatttatcaaaatctaatcctatctttctcaatcctttaaatatctgccctttgtgcgtaaactccgcaatattttcattgttgccgtctatggttttgcctgttaccacataaaaagcctttattctgcgttttggtttttgcatttaatcaggctcgctaattaattgataaagtgcaattccgccatgtggttgccctgtatggtctatgctattaattcttgtggtttcgatttgatagcctttctcacgtaactctttaattctctgtgcgggcgaggtaatccccatctgcctaaaatcaaaagtacttgagctacgctctctcaatacctttaaaatagttctgcactgtgtcgcttttgaattgtcttttagaactcctaccatactccccccttaacttgcgatatagctttcaatatcagctaaccgccaacgagtagaacgcccgcacttcttcgcctttggaaactcgcccttattcattagcttgtaaattgtggtagtagaaaagcctgtaatagcttttacttcttcgatattgataagtttcttttggtaaggttgaacagattgagcttgttcaatagtttggatagtttcgctttgtgttgtcataaattcccctttcggtttggtgttgtttgtgtgtggggaattgtgttggaaaataacttttatttcatcttattgatttttaaattaaaaactcgttttcaaataaagcttaattgaaaagaaaatccccttatttaaaaactaaaagggcttaattaaaaagattatttttgtttagaggggaatwtagaggggaatatagacaatccatttattcttaaattgtcatctattaaattgtctaaggttggatattttatatcgttagttctaattccatgctctttcatatccgcatttattgcgtcaaataatgcgtttctgctttgatagtcttgatagtttttaaacactagtagggaaaaaagatcgcgttgcggttggctaattcgtccttgctttggttgggttaaaacatcatcagatttaaccgcactttctgcccttttagcttgttctagctgtttttcaagttcggcaatttgttcatctttcgcttgaatggttgaatttgcttgttcaagttcggcaatgtgggcatgtagttcggctatttgttgcaacatcactaatctttcagctaagcccacggggcttttatttatatctgtatttcttacaaattcttcagttcttgtgagtgccattcctaccgctagttttatctcattttgatatttattatttaaagcctctttatcaagagtgcttattcctaagatattttctatctgttttcggtcaatgaaaatattattttggtaatctgtcaaataatcttttgcggtgcaagtgtcatcaaaaattagtgcttgtttatcagttttaatctcttctaaaacagaaaaaaattcactaccgcaaatactctgaggtttgttactaatatcttctgttataatgtatgtttttattccatgctctgactcccaacattcaaatgcttcatccccccacaattcatcatctgtttttctaatatcgtgcggttcaagttttatcaataatagggttgcaatctcactataacatgcttgaggattgtgtttctttataaattctagaagttcagaaatggaaataaaatcttgctctctctgctttcttattgctataagctcgcttgtaacatcaaacatcttaaacgcccctattcgtttccctatctagtgagggtgccacaaggaatagatagggctattccctttcggctcggttaattactcctagcctagttgcaccaatttgaaaattcatgcttggttgttatatataaaacaatcctttcttcttgtctatttgtatttcttcggttgtgtttctattttactgtttatttttacagtcatcaactaagctaaacaatcgtaataaatgcgtcatgaatcatttaccgttacaaaactaggacaattcaaaacttaaaataggacaaaacgacttctaaataggacaaaataacctctaaataggacaaaacgacttctaaataggacagattttattattaatattttataagttattgtttttattatatatattatttttacgtcctatttgtcctattactttttctatcgcgtataaaaaaagcatttttaaggtaataatagacaataaaaagccttgctagataacaaggctattattcattgaattgattttagattattcagaaagtgataataatattccgcacttttcgcaataatccccccatgcttgatatgcttgctttctttcctctaggtaatcatatctatcatatatagcctgtattttccctttccctgttgaattgtgtgctattgccaactctccaacgacaacagaaaagccaatctgactaagataggatctaaatactaccctcaacccatgtgcgtcttgtttatctctatagccgttatcccttaacgcattacttacagtatctagtcctatggttttatttctgtttctcactctggggaataaataagggcttgagccgttaaattgcctaattgtgcctataagtttaatcatttgtgaggataaaggaattatatgatctttgggctgttctcttagctttctagtttgtttcatgttctccgaggggataataagcaacttattaccatcatcaataaaagcccattcaatgcgtgttagctctttctgtctcaaccctgtgagcaaagtcaggttaaatgcaaagagtgtattaaactctagcttaccctccttgaaagcggtgtttattgcctttaatagctccggtagctctgcaggtgtaatagctgggtgattttttgccagtggtgctataaaatcatcttttgctaaattgcaattatgcccctctataatgcctagcttaatgccataatctagagtagctttgacaagtctatgtaatttatcaagagtattgctagcccctatttctctgtaaacgtctattaataatctaggtgttatttctgaaagtggtatttctgcgagcttggggaatatatgcctttctaacctttgccaattcctcgctctagtgtcttcattgggtgcttttgttgggtatatttcagcataccatttagaacaaacatatttaaaagtgtttcgttctaatgcctgtgtgttttgtttttggtctctgtgtgttttaggatcgatattttgagcgagcagggctaaatactcgtctcttatctttcttgcttgtagtagtgatatttcaggatatttgccaatgctgatttctgtccgctttttagtataaggcttgtaatagttaaaacgccatatctttgaaccgctaatctctacagataaaaaaagcccgttgccgtctcttaatggataagccttttttttaatcttcgctttttctatttctgtatttgaaagaggtttgattaatcttgccataagtttagtagtataaaaaataaaaaaataaagtgctttgcaccctttaaaatcaaggctctagcggtttttagtagtataattttttagataaaaatgtattttatgattttatactaccatttatactactaaaattcattgctttaaacatataaatacgaataaacacaaaagaagaaaaacaataaaagcacgttaaagccagtatttacaagggtttatttaatgaatttgaaagagtgggaaagaatggaaaattgaagttggtgccagtggtcggactcgaaccgacacgcttttaagggcggcggattttgaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaataaacgttgaaagttattagctgcaataaagtaataactttgttctgtcgcttcaatttcggtaattatttcctgtttcagtaaaatatgagcaataccgttaaaaaattgatgcaataaaaatgatacaaagcctgctgtttcaacttttacaggtcgacaataaaagtacttgtcataccaaattttaatgtcatcttttaattgttgagagctcacaatttcatgtacaacagcagagatattaactaaattaccgttgtgattcagccaaatcgtataacgattccaatccccttttttcaatggttctgtgcagatacaaaaaagatattggtaggcttgattatctagattacgattatcccagatgtatttcagtaaacctaaatcgtgtttcataatgtttctccaaaagaaaaaagtggagaaacatcttacctatagggaaaatatttccccacagggtaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatctctcaagtcaaacttgaaatggatatgcaaaaaatgctcaccagtaatacagcttcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgccgcttcattcgggaagtcatccatattttgcgtagcaagccacaaccaaattccaagttttcgccacatttttgaccctttcaccaagaatttggcaagtagaggattgacagtaataatgtgagactcatcagtaatattgacaatagggcgaaaactgtgttggtatttttctccaagactgttgatatggttgattaaggaaatataggcaatggaaagttctgcttcatagccttcacgagcaaacatggctaaatctactaaggtaatatctgcctccggccaaatttccccttcacggttaaaaaacttcccattgattccggtacagaacatatccatcgcttccgccatttctgctaaacgggtacgccgttcttcacgagtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttccctgtcgtcaatttttccaagagcggtaataacgacgccacaattttatcaaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatcaatattttgtacaaaacgagaaatttgtgaataattcggacgctcacccatttcaaccaaagctcttgcgacaatattcacaaaacgccaagcaaattccttaaatgcggcagaattccccgccccacttaattgccctgaaattctcccagcgacctctgaaacacgaccaaagcgaccaatagggttataacgtgctgagcgttcaggataccctaaatggaacatgtaaaattccttatcccgccctgctcgtttagcttcggcatacatacgttttaacatatcaggatcgcctttgggatcaaaaaagataaccacttcacgctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaccatcaattttaatcattttgatattgatcaagcgacctttcaatgctacacctgtatcgcctttcttgtgatttttaccctctttttgataggtaaaagtatcaaaccaaaggtctgacattacaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagaatagaaaggtgttccttttttcggctcaactaaacggatattgtttaaataacctaagccggttgtgtgaaggttaaaaaagtttttttgtgctgaagtttgagttgacatagtttgtttctccaaatgtaaaaaagcggagaaacatccttacccaatacgggaaaaatgtttcccgccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggcaatttgatttaatgcttgttcccataatgccgttaaccccggatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcattttttgcaaaagtgcgtttaaaatctacttaaaactctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttagtcataaaaaatctgtgccttaaccagttggtttttagtccaacttttggggtgcagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcctttgccgtttgtaatttctagtaatttagccgtaacgtcatcttctttggtggcaatcacaaaatccgcccctttctgtaaaagcacatcgcctttggcgtgcgtgcgagacagagcaatcacgtttgccccttgcattttggcgatttgaatggcggcaatgcctaccgagctggtcgctccgcccaatacaacaaaatcgcctttttgcaccttgccaaattcaatcaaaccgccgtatgcggttacaaacatcatccaacttgccgcagcttgatagaaataatatgtattctgaaagcgttgttagtctattatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttcagcttgacgacgataaaacacaatccgatgccattccgttaattctcgacgttctccggtatttttatctgtccaactttcgctggttgctacactaatattggaaaccgcttcgccatttggcattgttctcacttctggatcgttgccaagrttcccgacaataatcactttattaatccckgccatcgtatttactccttcaacgaattaaattaggtttattaaacttgattcagcctaagaaaaaatcatttaattaaaattctgttggaatgaatttnnnnnnnnnnnnnnnnnnnnnnnnnnnnnnnnnnnnnnnnnnnnnntttcttcgttaaggtaaggggcttgtccccttacctttaaaaggccttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttctcgtaatactccttcgcctgctgaatccccaatgctttctcaataaaggttaaatctgcacgggtgtcattctcaattaaatgaccgatcagcaaatcaagttccgcttccacactatctgccgtctcacctttccaaggtttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattcggcttatgatctaaccctcgacgacgaatagactctttgatcatctcaaagttagggttacgggttttccgagggttatgctcatacggacgcaacttatccagtgttactgtaatatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattttgaatccgctacgtctaccaatttcgtcacactggcagtgtgctttattgctcgacattatacgtttataaacttaccttgcaagtggtaatttaatattttggtttatttgttttaattttcaacaaagttacctcaaccgcactttacaaaaatattttatagtaaagtgcggttgtttttttactctctttttctattaagaagccaccaaatgagaatcataaaaagtaggcttggaatgagggctgcaagtacaattggtatatcatacagaaggcttaatcgccctaaaatttcgttgataacataaaatagaaacccaaaaaaaatacctgttacaatccttgctcctgcagtaacactgcgtaaagatccgaaaataaaagaaagtgccaacaacatcatcaccgcaacagagaccggttgaaagactttttgccaaaaagtaagttcaaaacgtttagcatcttgtcccgtttctttcatgaatttaatatagttgtataatccggtcatagacaacgacgttggacgcaaagaagctatccccagcttatcgggtgttaacgttgtactccaattatctttcaagcgattaatcgttttaatttcatcagcaaaaatttgtgattgattaattccgcttaatttccatttgccatgttcaaaacttgcttggttcgcatatgtaacttgtttcaattgacgcttatcatcaaaactataaatataaatatcattcaacctaatatcattagtaatacgaccaacatagataaaatcattaccatcttttgcccaaatactattttttactgaaagcatggagcctccggaaattgcttttgcacgcatatctctggcaaaatgttccgtctgcggaattccccattcgccaatgatcattgtaataagcaccagtggcagtgcggttttcatcacagctaaaccgattctaaaacgagaaaatcctgcagattgcatcacaataagttcactacgacttgcaaggttaccaagtgcaataagtgatcctaataatgcggccataggaaaaaatgtttctatatcttttggcatagttaataaagtaaacagtgttgcctgaataacatcgtaagttccttttccaatactacgaaattgttcaacaaatttaataatcgctgataaacccaccaacatcagcaatgtcgccaaaatagcacctaaaatattttttccaatatagcggtctaaggtattcatcatcattattcctgattaccttttacttgaattaaagttaaataaataacgtattttatacataaaaacactattccaactgttcaataaaacagctaaaaataaaaagaaaatactgactaacggcataaaaatatgtgcttcaattttaccggaagcccccgctgattttaatgaactttgtaacaagaaataaattaaatacaataaaagtgcgggcaaaatcttagcaaaccgcccttgtctcggattgactcggctgagcggtactgcaataagtgccataatcggaacagcaaaaattaaggtcaaacgccaatgcaattccgccttagctgcaggtgatttagaattaattaattcctttaggcttaaaatttccgtttcagatgtatccttatctgttgtcttataatctaaataggcttgatactggtcaaaatgcgtgatacgaaagtcaggtaaaagtgcgcttccttcaactcgctgactattttctagactaagaacttgatcgccattgggtaacaccttcaactgaccggtttcagctaccgttacggaaggcttctgattttttttattttccatttggaaaacataaatatcttgaatttgattgttttttatttcattgataaatagcacaacatcagtatttccgacattaacaaattgtcccgacgctaaagcccccattgttggatttgcttttgcatcatcaataagttgaatttgtttttgcattgcccaaggggatagataaaacacattataggttgccaatcctgctgtcaataaagataaaattaacgcaacaccaacaagaatacgctgaccaacaccacaagcccgcatgacggtaatttcgctttctgcatataaacgtccaaatgtcagcaatatagcaataaataagcaaaggggaaatataagttgtgccatcgtcggcatacccaagctaagcaaagcaaaaaccaaatcagccggaattttaccaacagatgcagaacctaatacacgcacaagttgttgactaaaaaaaagcagtaaaagaatagataagattgcaatttggcttctaaaaacttctttggttaaatatcgaattaatatcactgaattacctatatttctcttgcaattttaaaaaaaagcagtaatttacgaaatcacatacatggcgatgtatgataacgtatttttttattgaaaacagtaaattcgtgaggattacatgaaatatagtgcaaaaaataccgcactttctcaaattgacagcaacattattttagccgtatttgaggacggagaactttctccgacagcaatgcaatttgaccaactcagtcaaggctacctaactcgcttaattcaagttggtgaggttagcggaaaacagggacaagttctgattttacgggatataccgaattgccaagcacaacgtatttttatcgtagggtgcggtaaaaaagataaaataacagaacgtcaatataaacagattattcaaaaaacaattcaaacgattcttgagactcaagcaagtgaagttgtgagctttctaaatgaaattgaactaaaaaatcgtgatattcattggaatattcgttttgcaattgaaactattgaagcaagtttttatcaatttgatgctttcaaaactaaaaaaggcgacgaaaattcagtattaaatgaatttatttttgatgttccaaccgaattacaacaagatgcattactggcgattacttacgcacaagctattgcattaggagtcaaatatgcaaaagatattgccaattgcccgcctaatgtttgcaacccaacttatcttgccgaacaagcacaatctctcgctaaacactcaaacttgattaacgtgcaagttttgggtgaaaaagaaatggcagaattgaacatgttctcgtatttagctgtttcgcaaggaagtgctaacgaagcaaaaatgtcggtgattgaatatcgtaatcaccccgataaaaatgccaaacctattgttttagttggaaaaggtttaacctttgatgccggcggtatttcattaaaacccgctgatagtatggatgaaatgaaatatgatatgtgcggtgcagcttctgtattcggtgttatgtacgctctagcaacattacaattacccttaaatgtaattggtgtattggctggttgtgagaatttgccggacggaaattcatatcgaccgggagatattttaaccactatgtcaggattaaccgtcgaagttttaaatactgatgcggaaggacgtttagttttatgtgacgcactcacttatgttgagcggtttaaccctgagttggtcattgatgtagcaacactaacaggtgcttgtgtagtggcattaggtcaacataacagtggcttaatcgcaacagatgaaaaacttgctgaaaaattattaaatgcggcagaagaaacgaccgataaagcttggcgtttacctttaagcgaagagtatcaggaacagttaaaatctaattttgctgatttagctaatattggtggacgttggggtggagccattaccgctggtgcatttttagctaactttacgaaaaattatccttgggctcatttagatattgcaggaactgcctggttacaaggtacaaacaaaggtgcaacgggacgaccggtaagtttactgacacaattcttaattaatcaatccaaataactgtaaaagtgagagtttctcttttagaaaatgactgccaaatttcaatctaaacaaaaggaaactctcgttttttattcaaccaatccattgggcagaaatttcccccgcacttaccttctatctatcactatcattgcttaactaatacagctaatccggcattttgttaaatgttgatccataaaatttcagcataaaagatgattttataaataaaatgagctaaagtagccgagttttgtaacaaagatgatttttaaggatatgtcatgaaacagtccctacgtcataaaaaaataattgagttaataaagcaaaaaggttatttaagtacggaggagttggttaattttcttagcgtcagtccccaaaccattaggcgagatttaaatgaactggcggaaaataatctgattacacgtcatcacggtggagctacttcactttcaacatcagagaacagtgattatagtgaacgtcaacatttcttctcgtctgaaaaacggcgtattggtcaagaggtggcaaaaattattcctaacggttcatctttattcattgatattggtacaacaccggaagctgttgctaaagcattattggatcatcaaaacttaagaattgttacaaataatcttaacgcagcctatattttgatgcaaaacaaaacatttgatattacgatggctagcggatctttgcgtcaagatggaggtattattggtgaagcgacaattgcatttatcggacaattccgtttggatttcggaatattaggcatcagcagtattgatttggacggttctttattggattacgattatcatgaagtgcaagtaaaacgtgcaattatggaaagctcaagaaatactattttagtaacagatcattccaaatttactcgccgagcaatggtatatttaggttcgttaacagaagtagactatttgtttacaaacaccacaccacctgactccatgcttagccttattcattcaagcaatgtaaaactgcatatttgtcaatagaatttttatcaatagagatgtgtagaagattttatcttctacacaataatcaatttaatgccctcgccaataaactgacagggtgtaaacaagaagcacttgttgacatatcaatttgccatttgcaagtttcacattcagtgatgacataatcgaaacaaccttgttcaataacctcaaataaactttttccgatggcctgtgaagtctgatagttttcagatttaaagccatatgttccagcaataccgcaacattgagacggtaaaatagtaacatcaagatccggtatttgtttaagcaatgccaacgtataaggtgcccaccccgctttttctacatggcaggcggtatgataggcaactttaagaggtgtagacttaaagtgcggtatttttccatcaagatatagtcggtaaagatatttggttgcaatattgacatgaggacgaattctcgcattatccatccccaaaatatgatgatattcatcacgtaagttcattgtacaacttgaagatgtaccaataatatccaatgctttttcttgaatcacccgttcaatttgtttgatgttaaactctgcttgttttttagccttttcaggaaaaccgttcaccatgagcggcaaaccgcaacatttttctttttcaagcaaaatcacgccaatatcaatcgaattaagtactttaatgagatctttaccaagttgaggataattataatttacataacaaccgtgataatacactatcttatcccgaaaatagatctgacggtcaagagcatattttttataccattgacggaacgaaccgaatgaatattttggtaaagtgcggtgcttactgaccttaagggttttatctaaaacatatcgggttgcttttaatccagtaatcgcatttacaattggagcaaaaggcgtattcattttacccatgatatccgtattacttaatacagcatcacgtaatttatgtattggtgatttatgttgttggtcaagatatttatttctagcacgaatgataatatcaccaattttaacgtctgacggacaagcaacctcacaacgtttacaattgatacaatattttaatgcttcatcataaagtgcggcactttttaagcgtaaccgttcaccgtccggtcccgcctgtttaggtccgggatagaaaggattttgacgagaaacagggcaaaccacagtacaagcagtacattttatacagctctcaaaactttcatcggtatggtgctgagtaataggaaaagcagcatgttgttttgcattttcaatgagttgttgaatattcatattttgccccttatactcgattttgtgcttcgataatgctatcggcagctgttagtgcagtaacaactgccactccggaaccacaccctagttccaatgcattgtatccgccaataacatttccagcagcatataaatttttaataatctgaccgctcttttttaattggcaacggctgttaattgcaacgcccgcagactgataaggctgaggtgaagaaaaacgccgagcagtccaagtgagtctgttttgtatatcaatcattgaattgccaatcatgtccacatcaaatataggttcaagtaaacgatcaaaaacactcaccaaaccattactgaaaaaactaccggaagcaagaacaaaatgttctgcgaaaataccatgttcttgatgtaattgagtgtaaatttgtttaacctgttgatcctcaataacggcacgcaatgctttatcaccatttaaaataaaaccgcccagtttttcaaaatacgtttttaattttttatgttgacgcaatcccactaatgaaggtggtaatgtaggcaattcgtataaatttaatccagtttccaacgttaatttattgaaaaaatcttgattatccaaaccgaaacaagccggtaaaaaaattgcttccccatctccggacgcttgctttatttcttgtaccaattcacgaaatgccaaacggtgttcaagtaattgagaaatattgacactgcgaaactcacgagaagttaaacgcaattgatccaactcaggaagatgtaaaagtgcggttgttattgaacaatgtttaaattgcggatgttgtattaaattttcagccaataagtgcggttgaaaatcatgataaccttcaattcccaatacagtaattttttggtatccgaaatgttcatcatgaagatccattgttggaatacaatcagcggacagccaagtgcggtgcaatccgcccaacggtgtaacacgaaaatgattttgcttatagcttcccgtcacattgagattaattttttctattaattgttcaaattgcttggctttttgtaaaacatgttgtttaccaaataaacagtacggatgatttggaagttgttcttcaaggctgtcataaccttgttcaaaagaatttatcttttcaccgtttggtaattggcttaaaagatccattgaacctgatgaaaaattcatggctgattgaccattattaataatcgcacaacatttccctttttgttgaagcataattccgcaagttaaccccgcaagcccgcctccgataatcactacatcaaatttcattgccatctgttccttgctgtgcttgttcagttaaagattgaacactatttaagcctaataaactgtaatatatccaactggaaaattccgcttcacggattgcttcgccccaagcaatcggttcaatacctcgccaacgttcttccataaaagatgataattgcagtgtagattgtctaggtgttgccatatgaaaacgtgccattaatcctgccgcacggcaagcacaaagttcagcctggcaagttcccatgcccacacgtgtacgacgacgtaaatcaacaagattattgacttttaattcttctacagcataacgtacttcaccggcagtcaccgcttcacattcacaaacaagtgtacaatctgaccgctcttttccaatcaaacgagaagcccgttgcccatgacgataacgtgcggaaatttgaagaggtgttggtaacgatatgattttattaatatgaggaacattttgatcagattcagaacctggaagtaattcttgggcagttgtacaaacagtttgtttgccaagttttttactaactaaatcagttgcccattccgccatcaaacgataagtcattaacttacctcccgtaatagtgacaaaaccttcaagaccatcacggcttgcatggtcaagcaatacaataccacgactaacattacgtcctgatggatcatcatcactcgctaccagaggacgaacacctgcataggcacgaagtactctagtatgacgtaaactcggtgcaagtttttcgccttctctaaataaaatatccacctcttcgggagtaacaatcatgttatcaatttgatcataagggatacgatctgatgtggtaccgataacacagatagtatcgccaggaactaaaatatccgcatcagctggtttgcgacatcgattaattaccaaattattaatgcggtgccccatgacaagtaatgcacctttagcaggaaacatcttgactttgagatcggcatattcagcaatcccctgtccccaaattcctcccgcattaacaataacctgagcaaaaaaacggcgatttattttatttttgtgatcatatacttctgtaccaatcactcttccgccttcacgaatcagttgagtaactgcacaataggtaaaaattttagctccatgctcacgtgcatccaacatattggcagaggttaaacgaaacggatcaattgaaccatcgggaacaacaaccgcacctataagctccgggtttactgaaggctccattattctggcaaggtcaggctcaatcggtactgcttcaatacctgcttttgtacaggattgaataaatatcttttgataattaagatcgtcttcaggtaacgtaatgaaaagccctttggtatcttcaacacaatgacgtgcaatacgttttaagatcttattttctaagatacattcctctgccgattcatgatcattaacagcgtatcttgcaccgctatgcaataaaccatgattacgtcctgttgcacctgtggcaatgtcataacgctctaataatatgcagtcaatcccacgtagtgcacagtctcgtgcaataccggctcctgttgccccaccgccgataataatgacatcagcactgagcggtggaaaatctttagaaaatttttgagacgacattgacataatcatcccccacattgaatgtaaaaaattactattagaaagtgattatataatacgttaaatgttcgttttagaaaataaaatgcgtgatttcttatcaaataatgtgattaagatcactttattagtttcgatttgaattttttttgtgtttttttgtgatttacatcacaacataaattaaattagctttttagatttcactttttggttattatatgagtgaacgttcaaaaaagtgcatttatcgctcctaattttttatacataagattggtttgataattgctatattttaatctaactaaactactggagatttattatgtttggtccatttaagcccgcaccgtatattgaggagctatcaaaagatagaatcgatccaacttatagacggttgcgttggcaagtattcatgggaatatttttcggttatgcggcttattatttcgttcgtgctaactttgacctagctcaaaaagggttaattgaagccggtttatacaataaagcggagttgggaattatcggtacgggagcaggtttggcatatggattgtcaaaatttgtgatggcaggtatatctgatcgctcaaatccgaaagttttcttgcctttcggtttattattgtcagggttatgtatgacaatgatgggcttaatgccttgggcaacctccggtattgctgttatgtttgtgatgatattcttaaatggctggtttcagggaatgggatggcctccatgtggtcgtacaatggttcactggtggtctaaatccgaacgtggaacaatcgtttctatttggaactgtgcacataatatcggaggtatggtaccgggattaatggtattgttggcaagtgcgatttatttcagcgagtttggagtacaggcaactgcaaaagatatttggcaacaagccttatattatccaggtattgccgctatgatttgtgcaattccggtctattttgtgatgaaagatacaccacaatcttgcggattacctgcaattgaaaaatggcgtaatgattatcctgatgactataatgaaaaaacctatgaaaacaatttaacaacaaaagagatctttgttacttatgttctaaaaaacaaattgttgtggtatatcgctattgcaaacgtatttgtgtacctcattcgttatggagtgttgaaatggtcccctgtatatttaggagaagtaaaacattttaatattaagggtactgcttgggcatacactatttatgaattagctgcggtaccgggtacattattatgtggttgggtttccgacaaagtatttaaaggtaaacgtggtttaaccggtttcattttcatgattttaactactattgcagtggtagcattatggatgaaccctgcaacaccagaacatgaattagcacagtatgcaggaaaagcgtggtatcaaaatccatatcaattaactgacttcattttaatgacaacagttgggttcttaatttacggaccggtaatgttgatcggattacatgcacttgaacttgcaccgaaaaaagcagcaggcacatcagcaggtttcacagggttattcggttatctcggtggtacagtatccgcttcagccgttgtaggttgggctgcagaatactacggctgggacggtggcttctacgtcatgataaccggtggtattttagccatcctgttaatgtttatcaccatgatagaagaaggtaaacataaagcaaaactagacgatcattacggtaaataatcgttaaaaaggaaagacaggaaactgtccttcctttttctttattaggtttatgtattcaaattttaaccacatttttatcacagattttacttctacttaaggaaaatacaatgaaattagctacccctctttgtgcaattgctttagtagctgcaacactatcaggttgttctgcacaatttgaaaacaacgttaaccaaaaagataaaattatcattgctcaccgtggagcaagcggttatttacctgagcatacgttagaaagtaaagcacttgcttttggccaacacgctgattatctagaacaagatcttgcaatgaccaaagataatcatctcatcgtcattcatgatcattttttagatggtttaacagatgtggcgaaaaagtttccacatcgtcatagaaaagatggacgttattatgtagtagattttacgctgaaagaaattcaatcattagaaatgacggaaaattttagtctgaaagacggaaaacaggttcaggtttacccaaatagattcccgctttggcaatctcatttccgtattcatacttttgaagatgaattagaatttattcaaggtcttgaaaaatcaactggtcaaaaaatcggtatctatcccgaaattaaagcaccttggctacatcaccaagaaggtaaagatattgctttagcaacattaaaagttttgaaaaaatacggttatacgaaaaaagatgacttagtctatttacaaacttttgattttaatgagctaaaacgaattaaaacagaattgttgcctaaactaggcatggacgtaaaacttgttcaattagtggcttattctgattggggtgaaacacaagaaaaaaatgctcaaggcaagtgggttaattacgattatgattggatgtttaaaccggatgcggtagaaaaaattgcaaaatatgctgatggtataggccctggctggcacatgatgatcgatcaagaaaaatctaaaccgaatgccgtcgcttatactccattagcagaagaattggcaaaatataaattagaggtacatccttataccgttcgcaaagatgctttacctgacttttttgataatgtagatcaaatgtatgatgctctatttaaaggcggtgcaacgggagtatttactgatttccctgatacaggtgtaaattacttaaaaacccataaataattcgacattaatatctgtcattcttttaaacgaatgacagatttttgttcttgttgtaaatagccatttctccattatcctagcctttcaacctcaaccttcccctacgatatttcgtgcgtaaaagtgcggttattttatccggtgtttttattgcaatagaattagcaatctgtaatgagttatgaatagaatttgcatgggtaatggcaattgccaacgcatctgctgcatcaacctgcggtttatcggaaagttgtaataaccgaaccaccatttcctgtacttgtgatttttcagccgcacctgttccaacgaccgtttgtttaatcgttctaggtgaatattcaaatacgggtaaattttgattgactgcggcaactatcgctgttcctcttgcttgccccaattttagagcagaatcaggatttttcgccataaaaacctgttcaatagcaaattcattgggattgaattgcgtaataatttctgttattccggcataaattcgttttaatctagttggtaaatcatctattgaggtacgaataacaccactgcccaaatattctagcttatgcccaacttgacgaacaacaccatatccggttactcgagatcccggatctattcctaaaataatagacatcctattttccaaaaaataaatgaacctcatttgagatccatttaatatagactaaaaattattttgcaagtttaagagattgagctgatgaaacgtttttcatcatgcctctcaactaatttcataaatgttcccgatagaaaaaatgaagctaacttttaaagtaaagcagcaacctcatcacttatctcgccattatgataaacgttttgtacatcatcacaatcttccagcatatcgatcagtcttaacaatttaggtgcggtttctgcatccaaatcaaccattgtggaaggtatcattgttacttcagcattaacaactttaaatccggctacttcaataccgtctttcactaagcctaaatcttcccatgctgtgtaaatttcaacactaccgtcttcttgtacttgaatatcatcagcacccgcttcaatggctgcctctgtcaaggcatcctcgtcagcagactcaactaaaattagcccttttttactaaataaataccctactgagccttctgttcccaaattaccaccgcactttgtaaaacttggtcgtacttgagaaatggtgcggttagcattatcgctgagacactcaaccatcaccgcagtcccgcccggaccatagccctcataaattctagtttccatattggtgccatcaccaccgccgacaccacgctcaatagcacggttgatagtatctcgtgtcatattgttagataaagctttatctactgcggcacgtaaacgagggttagcaccaacatctccgccacctaattttgccgctgttactaattcacgaattaatttagtaaaaattttaccacgttgtgcatcttgtgctgctttacgatgtttaatattggcccacttactatgtcctgccattttatattccttttatgattgtacttttatattcattaatcgcctctgcattgttgggcgatttagtcaatttaattgcgtcctgtaccgaacaccattgataagctgaatgttcacttaaatttattactctttcatcagctaacggcaacaaaaaccaatgctcaatgcagtgagttatatcaggcgcatatttatacctaaaatgcggaaaaatttcaaactctatctgtttatggcaattaaagagcggtaagttttccgcaagaatatctatgcctgtttcttccctcacttctcggattgctgtttgaacaggtgtttcacctatttccatcgtaccggttacggattgccaaaattccgaatcgtcttgacgttgcagcattaaaatacggttggttttcttggcataaataacgaccaaaatactgttgggatttttatagttcatttggattaccttcttaacgtcatcatcactcacattaaccaaaataatgttaaatgaaaaaacaacaattgatctgccccaaaatctcttaataaatcaaaatattaaaacatcattaataattaagatagcatttcaaatttcgtatcattgctacatagtaccgacttttttagcaaatttttctacctttttcttttcttctaattctttttgttgttgctctgcacgtttacgacgaatttctttcggatccgccaataatgggcgataaatttcaatacgatcaccttcattcactatatccgttaattttgccgggcgactgaaaatgccgactttattttcacgtaaatcaatttccgtaaattcctgcaaaataccagattggaaaatggccgcttgaatgattgtccccttctcaacttgaagttttttcaaataatatttatgcggtaacgcataagtaatttctatattaatcaagataaacgtcctttgctcgttgtttaaacgcttcgatcattttcgttgtcaattgtgaaaaaatccgcccgaaagcaaaagcaataacagggttggaaaattcaaactccaattgcaacgcaatttcacaactttgctcatcaatttcacgaaaaacccatttaccctgcagatatttgaaaggtccggaagctaactgcatcgtaatctcttggttgggaattaattgatttttagtcgcaaaaacctgtttgataccggctgtactaatggttaattctccgatcgtttcattgtctatcgactgcaatgcttttgccgcaatgcaatggggtaaaaattgtggataactttcgtaatcattaacaatatcgtacatttgtttagcactataagacactaaagctcgctgatttatacttggcataaaataagatgttgaacaaaaaatgttgcaattatagcggaaaagtgcggtagaaataagagacaaaatagaaaagaatgattcatacaacaagcagttaatgtcgttgctttctaattgagcatacatcaattttccgctacaatagcccactatttttagcgaacaaaaataccaatgtcagaaattaaattaattgtaggtttaggcaatccgggcgataaatacgccgatactcgtcataatgcaggagaatggttaattgaacgtttagcaagacgctttaacttcaatctctctgttgaatccaaattttcaggaaaaacggcaagagcggtcattagtggtcaagaaatgcgttttcttgttcctaccacttttatgaatttaagtggcaaagcagtaagtgctttagctaatttttatcgtattccgccggaacaaattttagtgcttcatgatgaattggatttttccccgggcatcgctaaaattaagcaaggcggaggacatggcggacataacggtttgaaagatattattgctcaactggcaaataataaaaatttctatcgattgcgtataggaattggtcatccgggtgataaaaatttagttgcgtcttacgttcttaataagccatctcccacagatcggcaattaattgaccgctctttagaggaggcgacggattgtattgaaatcctcatgaaagagggaataactaaagcaacaaatagactgaatgcttttaaagcataaacaaaattcaccaatctttgggctgaaataactcttctactctactaataaaaaataggaaaatttatgggatttaaatgtggtattgtcggtttacctaatgtaggaaaatccactcttttcaatgcgttaactaaagcaggtatcgaagcggcaaactatccgttttgtactattgaaccgaatacgggcgttgtaccgatgcccgatcctcgtcttgatgcactggcagacattgttaagcctgagcgtatactaccgaccacaatggaatttgtggacattgcgggattagttgccggtgccagtaaaggtgaaggtttagggaataaattcttggcaaatattcgggaaacggatgctattggtcatgttgtgcgttgttttgagaacgatgatattgttcatgttgccggtaaaattgatccgttagatgatattgaaacaattaatactgaattagctttagcagacttagatagctgtgaacgagctattcaacgcttgcaaaaacgtgcaaaaggtggcgataaagaggcaaaatttgagttgtcggtcatggaaaaaattctacctgtactggaaaatgcaggtatgattcgttctttggatttagataaagacgaattacatgccattaaaagctacaacttcttaactttaaagccaactatgtatattgctaatgtgaatgaagatggctttgaaaataatccatatctcgacaaagtgcgtgagtttgctacaaaagaaggttctgttgtggtaccagtttgtgctgcaattgaagcggaaattgctgaattggatgatgatgaaaaaactgattttttacaagatctcggtattgaagaacccggtttaaatcgtgttattcgtgcaggctatgcgttattaaatttacaaacctacttcaccgccggtgtaaaagaagtgcgagcttggacagtttccgtcggtgcaacggcacccaaagcggcagccgttattcatacagattttgaaaaaggctttattcgagcagaagtcatcgcttatgatgattttattcaatataagggcgaggcaggtgcaaaagaagccggtaaatggcgtttggaaggtaaagattatattgtgcaagatggcgacgtaatgcacttccgttttaatgtttaatattcataactaattttataccgcatttttcgatttgaataataaaagtgcggtattttttagagagaaagatgaaatatcactttatttcccggtgttccattaaagtttttaactgggagacgtttgttgatgttgaagatttagcagatgatcctgcgagaatacaataaccgaatgaatgatctttagtgtggcttgtgtcataataggcatcgttttttcagcgacttagaggagaatgattacatgagaattttacatactatgttacgtgtgggcgatatggatcgctcgatccacttttatcaacaggtattaggcatgcgtttattgcgtacaagcgaaaacactgaatataaatattctttagcttttttaggctatgatgatgaagaaaactcatctgttattgagctaacttataactggggtgtaagtaaatatgaaatggggactgcttatggtcacattgctattggagttgaagatatttatgccacttgtaaagcggttaaagaagcaggtgggaaaattactcgtgagcctggtccagtaaaaggcggaaaaactgtcatcgcatttgtggaagatcctgatggctataaaattgagtttattgaaaataaaatggcacaagcagggctaggtaatcaataacctcaacaatttttatcctaaaaaatgggctttttatctgtctattttaagtattacatttatctcattcttataaggcaatatttcgtgaccgcactttcagaacaagcagtggattataatttacttaaaaatcgctttcggggtttttttcctgtcattattgatgtggagacagcaggctttaatgctcaaacagatgccttgctggagttagctgcaatcacactgaaaatggatgaaaaaggtctattagtaccagatgaaaaatgccattttcatattcaaccgttcgaaggggctaatattaatcctgaatcactcaaatttaatggtattgatatagacaatccgttgcgtggtgctatatcagaaaatgttgctatgagtgaattgtttaaaatggtgcgtcatgggcaaaaaaaggctgactgtcaacgttcagttatcgtggctcataatgcgacatttgatcaaagttttgttatggcagcagcagaacgtacgaaaataaaacgcaatccgtttcatcctttttcgatatttgataccgcaacgttaagcggttttatgttcggacaaacagtgttggtcaaaggttgtcaggttgccaatatttcttttgatggaaaaaaagcacattctgctttatatgatgcggaacgaacagctgaacttttttgttatatggtaaatcatttaaaaaaactgggcggttttccccatgtggcaataaactcataaaaaacggtgctaacaaagcaccgctcttttgcgttactccttattcaaattactgtacaacaatactccctaaacaaccttgatcagctaacactaaatcagatgaaccgaaaataaaagggaatttagtagaggacgcatgattaaattgcactaaaatttctaccttgccgtcaatccaaagactatctttccatgcaatatccgattgttctaccggctgatcatttatgcttttcatgacaaaacgagcaccttgaattttaaatccgacgggccttgaagaacttagaatccagcgttctatctgccctcttttggtactaatgtctattctattcggttcaaaccgttgttgattaatggttgcattgctcacatcaaaataaaactctctcgttttcatatttttctttgccaataaactaggtgcatcagtatgaaattgccaatgacttggattataaaatactgatttaaccccctctgttcttaactcaacaataacattatcaaccagcatatcagaactgaatattgtacctatcttattcaaaagatttcttttactaccggtaattaaggtagcatttccgccctcacttaagtcaaccaataattcaaccctttcactaggtgcaagagaaacttttttgacaatttttgtttgtggcaaataaccttgttctctggcaatcaagaaaaatgcccgctcatcatcaaatgttaaatcataagaacgagataaagaggcattcaacaaacgtaaacgtaccaatcctttaggtacattcaaataaggtgcttcaacaccattgaccaataaccgctcgcctagaaagtgcggttgattttgaaatacttgctctcccttagaatttaacagtacatcttgcaaaataagtggaatatcatcaacgccatatttttttggcagtttagattgatgagtatctttgtcatttataatccacataccaaccaagccacgatacgtttgatacgctgaattagctaaagtgcaggcatgataaaaacaagttgatgccggttgagtaataggtaaaattggagcccatccttcccctgccttcaatactcgcccaataccaccaattaattcactgtgtgcttgtaaaccttgtatattcatagcaactgcctgcgttaaattattacgataatttaacttcacaaaatcaccttgctcaactcttacggtaggacctaaatgatgcccattaaatccccaaacttccgttagctttttttctatgaatgaagtttgagcagcttgcatcattaaaaatatcggtcgcccacgttttgcctccaataacggtggaataaataaaggcaaacggctagcagccattactgattgagggatacatgataaagaactggctaaaataccgcttttcaaaaaatcccgtcgagtcaaagatctcatattttaccttgctgcttatacagattgctgttgaatttctgcatcaagctctgcgatgcgttgttgcataatttgatgacaatattcagctaattcccgtacattatcctttgtgtagtttgatgtatctacaggagacatcatttcacaaatcactttaccattgtcccaccgatttaggtcaatgcgattatgggtggttgaacaaacgaccggaacaattggcacaccagcggtaattgccgcataaaaagcccccattttaaaaggtaataatccacgcccacgactacgtgtcccctcaggaaacatccaaactgacaaattatcttcatttatacgatgagcaagttggtttattgtattatgggctttggagcgattttctctgtctaacaaaatatttcccgttgcccaataaagaagaccaaaaaagggaatccaaaccaaacttttcttgcctacactgactgtacgagggcgaaccatagcagaaacagtcaccatatcataattattttggtgattaccaatatagatgcacctaccgatactatcgacattttcaggaaaacgatgttcaacttttaatccaaaaaaaggatataaatgcccaaaccagcgagccatcacacctacattacttggatttttaaaacgaataagtgaataaagagatcctactacacaaattaaaatactacagaagataacaacgatggctcttaataatatcaacataaatatacccctaaaaatttgtatacgccaagtataacgaaaatctaaaaataagtgtagaaaagcataaaaaagtgctaggctagcacaaatattttaggaacctcagcatgaaaaaaacattctttattgcagatttacatttaagcgaaaaccgaccgcatttaactgaactctttgttcattttatgcaaacgcaagcactacaagcagaaaagctttatattttaggcgacttatttgatttttggattggtgatgatgaacaatcagccttgatcgaaacagttcaacaacaaatattacagctcagccaaaaaggtattccttgttattttattcatggaaaccgtgattttttggtgggaagacattttgccaacagttgcggaatggagttattaccaacctatcagatcgttaatttatatggtaaaaaagtacttatttgccatggtgatacgctatgtactgacgatcttgattaccaacaatatcgcaaaaaagtacaacaaaaatggctgcaatggctatttcttcacttacctttaaaagtgcggttaaaaattgcagaaaaaattcgccaaaaaagcaaaacggataaaacacataaaagtattgaaataatggacgtcaacaaggattttgtagaacagattatgcaacagtttcaggtcaacattttgattcatggacatacgcacaagcagaatattcatcaaaatccaccgcactttactcgcatagttttaggtgattggggagcaacagcttctgttttagaggtttcagccaatgggtttcagtttatctaattcgtcaggcacaaaacctaaacataaagaaaaagagatcaaaatatgccctttttccatcacaactaaattttttccaatttggctaaatgagcgactagccatttaatcccttgtccctgaaaagcgatttgcaatcgggtattattatcagccccctcaacattaatcactgttccctgaccaaatttttcatgtttcaccttttgtccaactttccaactattatccgataaatcagttttgacgatagaacccactgcacttcggttataagctcgagtcactgtgccacgtaaacgaacttcttgaatacattcttgcggtaattcagcaataaaacgagaaggaatatgtttttcgtctttaccatacaagcggcgaacttccgcataacacaatgtcaatttctgttttgctcgagtaatccctacataagctaaacggcgttcctcctccaaacgtgccaagtcttcacccgaacgaaaacttgggaaaagcccctcttccataccaacaataaatactcttggaaattctaagcctttcgctgaatgcaatgtcatcatttgcacacaaggctggtgagagtctgcttgttcttctcctgcttccaaagaggcatgtgttaaaaacgccactaaatcagacatatcttcagcctcatccggttttataaattctctcgttgcggtaaccaactcctccaaattttcaattcgcacttcccctttgtcccccttttcctgtttatacatgtcatataaaccggaatgtttaatcacaaaatcagtttgtacaaataggggcatttctgcggtttcttgttgtaaggaattgattaattcaataaaacgtaacaaaacagttaccgaacggataggaattaaattttcttgaatggcaagctgagttgcttgccataaagtcacttgtctttcacgagttaaattacgcaaaatatctaaagtacgctcaccaatacctcgtggtggcgtatttacaacacgttcaaaagccgcatcatcttgtcgattggcaattaaacgcaaatacgctaaagcatctttaatctcttgtcgttcaaaaaatcgcataccgccataaatgcgataaggaattttagcccttagaaatgcctcttcaatgacacgggactggctattactacgatataaaactgcacaatcatcaaccttaccgccgttatccagccaattttgtacctgaccggagacaaacaaagcctcatccaactcgttaaaagccgcataaatccccacaggatctcctttttcacccgcagtccaaagatctttacctaaccggttactattattggaaattaaacggtttgcactttctaaaatgttgccggttgaacgataattttgctctaaacgaataattttcgcttttgcaaaatctttaagaaaacgatgaatattctcaacttgagcaccacgccaaccataaatagactgatcgtcatctccgacaatcatcacattgccttgcgaaccggctaataatttaatccaagcatattgaattttattagtatcctgaaattcatcgatcaaaacgtgctgaaaacgctgttgataatattgcaaaatatgtggattttttagccacaattcataagctctcaataataattcagcaaaatctactagacctgatcgatcacaagcatcttgataaattttatagatcttgatccactctcgttcttgacgatcattattatcttcaatctgatgagggcgtagcccttcttcctttttattattgatataccagcaggcttgcttataaggaaagattttttcatcatattgatgcaatttcatcaaacgcttaactaagcgaagttgatcttcactgtctaaaatttgaaaatcctgtggcaatccggcatctgcataatgggatcgcaataagcgatttgcaatgctatgaaaagtgccaatccacataccgaataaacgttgatgggaataacgagctaacgttgcctcaatacgatgacgcatttccgtcgctgctttattggtaaaagttaccgccataatacttgattcaggtattttttctaccgcacttaaccaagcaatacgatacgttaatactcgagtttttccgcttccagcaccagcaagtacgagataattccccaaaggtgcaacaacagcattgcgttgtttttcattaagatcattaagtaattctgaaatatccattgtcgcccataaactgtgtttttatacagttgattatattgttttaaccggaaaaagcaagataagaatcaccgaataaatgctgaagcatatttcgccaactttccttcccaaatgtccaatccgtttaaatatcaaacaaattttctacataactcgaatataaacggttatttcttctcgatcatgataaagatgttttgcttgtatttggaaagatatatgttgttcatttagtctttctttaatttgttgtaaacaccgcttaacctcaaaataacgctttttcattggtaattttaagttgaaaatagtttccttacaccaacctttgattagccattgactgattaaatcagcaattctatgtggctgttcaaccatatcgcaaaccagccagtcaattttacaatgcttaggaggccgaaatttaaagccatcttcagcacaatgttcaattctgccggtctcatgtagacttgttgccattttgccatgatccactgcatacacaaaaacacctcgtctaaccaattgataagtccaccctcccggacaagcccctaaatcaacagcatatttattttcgttaaaacgtgttgcttcttgattggggggaataaaataaagaattgcttcttctaattttaatgttgaacgactaggcgcttctgccggaaattttagtcgtggaatccccataatatgttcagcatggttattgttataggaatagccaatgtaacaactgttggattgagtgaaaaaaatatgcagagtaataccgctctttttgttttttgcttgtagccagccttgctttctgagagcttgtctaagcggtacagtaaattttcgacaaaaagcggcccgtgttttagcttcattggtatcggcggtttctacccaaatatcactactctgtttgagattgaggattttttcttgttgacgataatattcaataatcggactgatacgatcttgcacggaaagattactaataagatcagatacgacaatcagttggcgagcaaaaatcagttgactaaatgtaatctttctagcgaggagatccgcctcaccgatttggtaacattcaaaaataacataacctgaattttctactactctggcaaagccaaaaacaccaagtgcggtggctttttcggttatttccgccgccaattctttttcaaagccactgcggcaatataacgctaatttattcatgtttattttgcttcattgcatgcacaatccattgacggaatgcgttaatttgttctgtattggttcgattaagagaatttaccacataaaaagattttggatccggtagagagatagataacacaacttgtaagtttccgttctctatttcgtgttgagcaagaattttatttgccaacacaataccttgtccatgcacagcggcttgtaatgccataaatgtatgactaaataccggtccatgtcgaatatctaatttatccagttgaagtaaattcgccatattacgccagttatctctagtatgaacatgaataagattatgctgatacaaatctgttgcttgcgtaacaggttgtttagcgagtaatttaggggaagccaaaatcaacaattttgcctctgccaatttttcaacttgtaatcccacccaatttcctttgccataataaatggcaatatcaatttcattactcaaaggtatttcgtcttgatcaaccccttttaatctcacctcaatatccggatatcgttgattaaattcacttaattttggtacaagccattgcataccaaaagtttgcggaacgctaattgaaagatattgctcatttttctgagccattaattttgttgtagcatcggctaaattatttagaattttgctgacatcggaaaaataagcccgacccaaatcggttaattctaatgttctatttttacgcttaaataatataacacctaaaaaatcttctaataattttatttgatggctaactgcagcctgtgtaacaaaaagttcatctgcggctttagtaaaacttaaatgccttgctgaactttcaaaagatttcaatgaatttaaaggaggcaaacgtttaatcatcattcttcccaattgtattgtttaaattataacggttgaaattgctatcagattagtttttctaataccatatataaaaaaatatatcttgtctgacctatccattctccatagaatgcacgcatacttaacgattggtaattccttactggttaaagagtttcggacttaagtatgatgttgtgtttgcatattgttcgggaaaccgaaccgagtaacaaattttaagttactcatttacttcctgtatgtatatttaaaccgttttttaggttatgtaccgctctttatgagcggtatttttttatgggcaaaattctatcataaaatttcccatctctatcattccgagcgataaaaatccctttatattttaaatatccagtttccaacctgatgagaatagtgtagattaaattcactattttataaacatcaagaaggaagtaaaaatgaataaaaatattgattgggaaaatctcggttttagttatatcaaaacagattatcgttacattgcttattggaaaaatggagcatggtcaaaaggtgaattgatacaagataatgttttgcatatcagtgaaggttcaaccgcactccattacggtcaacaatgttttgagggcttaaaagcctatcgttgcaaagacggctcaattaacttatttcgccctgaacaaaatgcactacgcatgcaaaaaagttgccaacgcttgttgatgcccgaaattccggtggaaatgtttgtcgatgcctgtaaacaagtcgtcaaagcaaatgcagattggctaggtccttacggttccggtgcaacactttacttacgcccatttttaatcggtgttggtgataatatcggggtcagtccggctcctgaatatatattctcaatcttttgttgtcctgttggtgcatactttaaaggcggtatgaaaccgactaactttatcgtttctgactatgatcgtgccgcaccacaaggcaccggagcggcaaaagtggggggaaattatgccgccagtctttatccggggaaaatggcgaaaacacgtcattttgcagattgtatttatcttgatccgactacacacaaaaaaatagaagaagtcggttctgcaaacttcttcggtataactaaagacaataaatttattactccattatcgccgtcaattttgccaagcattactaaatattctctactctatctagcaaaagagcggttaggaatggaagtgattgagggcgatgtttatattgatcaattagatcaatttaaagaagccggtgcatgtggaacagcggcagtcatcacgcctatcggtggtattcaatatggcgatcatttccatgttttttattctgaaactgatgtaggtgaaataacaacaaagctttataatgagctggtcggtattcagtttggtgatgttgacgcaccagaaggctggattgttaaagtagaataataaaaaatacacaactaatctgcaatttaatcaagtaactttccgatgaaattgcagattttttctgacataaaaatatcttaacgttgttccaatgaatttaaataatccaagacaatttgatgatgatccgtagttttaaatttatcaaaaacttgttcaatttttccctgttcatcaattaaaaaactaatgcgatgaataccatcaaaggttcttcccataaactttttttctccccaaacaccgaattgttctgccacaatatgttgctcatctgaaagaagatcaaaattcaatgctttcttttctataaaattggctaattttttcggcgaatccggactaattcctaaaataacaacccctttattttctagctctgctttgctatcacgcaacccacaggcttgcgttgtacaaccaggcgtcaacgcttttggataaaaatagaccaatacttttttcccgtgaaaattctcaagactcacctgttcattattttgatttaatagactgaagtgcggtgcaaaatcgccggcttttaatgttttcataaaatattaccttttaaaaaatataaaaaaatacttgcaaagtgttgccattttaacgatcctaaacggactttttcaagctaatatgcaaacataataaggagattttatgaccacacacagacctttattctacggcagtatcaccgcacttatcacaccaatgaataatcatggagaagttgattttaatgcattaaaaaaattagttgaataccacattgtctcaggaactcacgctatcgtttctgtcggtacaaccggagaatcagctaccttaagtatcgctgaaaatgtaaaaacaattttaaagactcttgaatttgccgatggaagaatacctattattgcaggtaccggagcaaatgcaaccagcgaagcgattacgatgaccaagctgttaaatgatagtggtgttgcaggttgtttatccgttgtaccttactacaataaaccaactcaagaaggtatgtatcaacattttaaagccattgcagaatgtacggatattccacaaattctttacaatgtcccgagtcgtaccggtagcgatctattgcctgaaactgttggtcgtttatctcaaattgcaaatattgttggaattaaagaagcaacaggtgatgtcagtcgtgtagcgaaaattaaacagatggcgggggaagatttcattttcctcagcggcgatgacgcaacagggcttgaaagtatgaaacttggcggtcaaggagtcatttccgtcacaaacaatattgctgccgctgatatggcaaaaatgtgtgaattggcattagccggaaaatttgatgaagcagaaatcattaatgataaattaagagctttacataaagatttattcatcgaatcaaatcctattccggtaaaatgggcagcttataaattaggattagtccctgatccgatattacgtttgccgctgacaactttaagcgaacaggcacaaccgcaaattattaacgcattaaaaaatgccggattgctatagtcttcttactaaacattggggtctacaaacgcccctattttttaaccgatttctacgttaagtgcggttgttttnnnnnnnnnnnnaatttttatttttttctagacgtttgtattgtataattcgtcgcctactgttatgcgtacaatctacgcttatctttttacaaaataaggactttttatgaaatacaaactgtcgttagcgttattatttacgcttccagcctttgcccatgcgggggggggaattttaatttttatggcaaggcggggattgatttaacctctcgttttgaaacgatgagaatagtatcaaatattaatggagaggtaacaaatcttcctacaagctcaagacaaaacaccttctcaccaagtatctttcttgaaacgacctacaatattttaccacaaacagaaattggtctcggattaggctatatcaaacgtaaaggcttcgatcattctgcgacttggcagatcacacctgaaggtaattacggaataggtggagatgttaatgtaatcgaaaagtatagaataaatcgttattcctccctaccaatttatttcacgttgaaacaaaattatgcgttaaatgcaaatagtaaattttatctaaaaggggatattggctattcaattaacaaaattcataacacaacatatagttactattcagatctagatcataaaactacaacgactaatcgcaatatgaaagccaaaaacggtttgtatttaggtttaagtattgggtttgaatataagtctttcttagcggatattggatattaccatactcatgcgacggttaattacgaaagtaacggctactattcatggcatccttacaacaacgatgctatacgtttaacacttggatttaaattctaaacaacacaaaacagaataaatctttaagctaaacttttaccataaaaatccctattgaaatattattcagtagggattttaatattttcaatcggttacatctttnnnnnnnnnnnnnnnnnnnnnnnnnnnnagtgccattaccaccgcactttcccgctttccgtcaggtaaaggataataattcttacgaatatccacctcattaaaacccaaattgtgatatagctgtcttgccttaatgttcgtttctctcacctcaagccataaggtttgtatattacgttctaataattgttgaattaattctttcagtaattcttttcctaaccctaatccttgataatcaggatcgacggcaatattaaacaacgttgcctcatctaacacaagatgacaaatggcaaacgcaacaattttgccattaaccactttctttaaattaagataatgttcgccttgattattttttaatgtgcttaatgaccaaggaacaatatgtgctttttgttcgatcgcaaataattcggcaaaatcttgttcatcaatatatgaaatcattttctatatttcctgaatttgctgccaaaactgacgtttttcctgaggactttgctttaatctctcaagctcattacttttccaacaaggcatatattgcttatcgcttaaagtgcggtctattttctgttgatcgtttgtgagtaaccaataaattacttcatgttcgacttgaagataaggcaaaaaatcaaagtcaatacataaacaatcttctttcattagctcaagactacgaaaaatatcttgtaaaaacggttgttcttttaaaaccggctgttcagaaatcataatcaaacgaatattttttgccacagagacatttaccaacccttttaaaatctcgggatggcgtaattgccactgtgaaatacccatttcttgtaagagtttatctcgtctgttcatttctattttcctaaataacaggctattttaaaccgtaaccgaaatgaggttaagcaataattgtgtccatttttagctcttggatttgatataaagtgaagaaactcaaccgtagaagatcaaacctaaataagaaatcattaaattagttttgaccttctacactccagtagaattttaattcaaactttttgttcgagaagaacgcttacgagaagatttaattttatgaattggagaaagcttcacaaaatcaactccttccggtggattttctaatgcaattgttaagacttcatcaatagtgtcaaccgcatgaatagttaaattatttttcacattttcagggatttcttccaaatcttttacattttctttgggtataatcaccgttttaataccacctcgatgagctgctaataatttttccttcaacccaccaatcggtaatactttgccacgtaaactaatttcccccgtcattgccacttcagattttaccggattaccggttaaacaagaaaccaacgctgtacacatagcaatacccgcacttggtccatctttcggagtcgcaccgtccggtacatgaatgtgaatatcacgtttttcatgaaagtcattagcaatacctaacttttcagctcgagttcttacaacagtcatcgcagcttgaatactttctttcatcacatcgcccaaagaaccggtataaatcaatttacctttaccgattacagatgccgtttctattgttaataaatcaccgccaacttcggtccaagctaatcctgtcacttcaccaatgcggttttgtgtatctgctcgaccaaattcaaagcgtctaaccccaagatactcttgcaaattgttagaattcacttgaatagatttcaaacttttatctaatagcagatttttcactgctttgcggcaaattttagaaatctctctctctaaagaacgaacaccggcttctcgagtataatagcgaataatatctaaaatagcctcttcattgataaccaactcatcagtcttcaatccgttacgctcaatttgtttattcaataagtgacgtgtcgcaatattgagtttttcatcttccgtataaccggagagacgaatgacttccatacgatccagtaaaggtgctggaatattcattgagttggacgtagcaacaaacattacatcagataaatcataatcgacttcaagataatgatcattaaaatgtgaattttgttcaggatcaagcacttccaataatgcagatgccggatcacctcgataatccattgccattttgtcaatttcatcaagtaaaaacagcggatttttcacccccacttttgccattttttgaattaatttgccgggtaaagaacctatatacgttttacgatgtccacgaatctctgcttcatctcgcacaccgcctaatgccatgcgtacatatttacgccccgttgcgttggcaatagaatgccctagcgatgtttttcccacacccggagggccaactaaacataaaatagggccttttaattgatttaagcgactttgtaccgctaaatactccaatatacgctctttaacacgttctaagccatagtgatccgcatctaaggtttcctgtgctttggcaagatcttttttaactttagttcgcttatgccaaggaacttgaaccatccagtcaatataactacgcaaaaccgttgcttcggaagacattggcgacatcatctttaatttttgcaattcggcaaacactttttcacgagcctctatcggcatcttagcctcttctattttcttgcgtaattgctcaacttcatcaactgtgttttcatcatcattcagctctttttgcaatgccttaatttgttcattcagatagtaatcacgttgatttttttctatctgttttttaactctgccacgcacacgttgttcaacttgcaatatatcggcttcgcttaccattaatcctaataaatattcaaaccgtgccgacaaatctcctatttctaggatattttgcttttcattaatagataccggaagatgagctgcaaccgtatcacttaatctctctatatcattaatacgtcgcaatgcagaaataatatctgcgggaatttttttatttaaattcgcatatttttcaaattcggataaagtaattttcttcaatacacttaattctttctcatcactccattgtgtttcaattaattcgtgagacgctaaaaagaattccccattatcttgtaaatcaataagtttagttctttgttgtccttcaacaagaacttttacagtaccatccggcaattttaacaattgaataatattgactaatgtaccaatcttataaagatcagcgatcttaggttcttcaatgtcaggttttctttgtgaaaccaataataattgcttattattttccatcgcctcctctaaactacgaatagacttgggacgaccaacaaacaatggcattaccatataaggaaaaactaccacatcacgcaatggtagaaccggaagatgctctagcttagttcgttttgcgttcatataatttactctctttcttaaaaatagactgaatgcacaggatatgggggctttttgttaaagttcaagcgaaacccaacctgctaaaacaatcaacatcattctatctaaaatgctacaaaacatgccggcactttcttttgcttatttcgaagaaaattcaagcacctgttgtacgaagagtgatgtatctttagaaataaaaatctgcaccttaatcagttgtttattcactccaacttttagtgtgcagatcattttcaagtgcggtgtgtttttataaggattttactttttagggtgatccataaaacggaagaaatcactacccggttttaaaatcatcatattattcgaaccttcaaagctgttttcataggctttcatactacgcataaaactgaaaaactccggttcttgagcaaacgcatctgaatataattttgctgctgttgcatcgccttcacctcgcaactcttgtgcctttttacttgctgttgccaaaataaccacaactttacgatcaacatcagcttgaataaatgcggctttttctttaccttgtgaacgatgttcacgagccactgcatcacgttcagcacgcatacgttgataaattgaagaagatacttcatcaggtaaattgatctgttttacacgaacatctacgacttcaatacccaattcagcagtactatcttgtcctgtattcaatgctttcttcgcatcttccattaattcaccacgagtaccggatacaatgtctttaatagttctggagccaatttcagaacgcaaacgatcatttactttacggcgtaaaagattcgaggcttgtacataatctccgccactagtggctgtataaaagcgaccgaaatcactaattctccatttaacataagaatcaactaatagatcctttttctctacagtcacaaaacgatcaggttgaccgtctaaagttctaatgcgagcatcaaggattttgacgtgatcaataaatgggattttaaaatgcaagccagggctataaacaaccactttattatctgcatcacgatgtactttactaaaccgtagcataatgccacgagttccttcatcaataatcacaacacttgaataaatcagtgcgaccaatacgataagaataggagttaagaatttacgcattaattaaatctcccttgacgaccttctataacttgataaagactgttcggttgcgaaatttccggatttgttaccgctctttcaggaacctttttttcacttgattgatcagttttaacgagcgtattgcttttctctgctaacgttttactattcaagatctgctctaacggcaatacggttaaattatttccactctgtgtatctaacatgactttcggtgtattcgccatgactttttccatagtttgaatatacaaacgttcacgtaataattccggcgatgctttaaactcaggtaataaacgttggaaacgctctacttcaccttgtgcatccaacacaacttgttctttatatgctgtcgcctgctcaataatacgttgtgcatttccacgagcccgtggctcttgctcacgagcataagcttctgcctcacgaatatagcgttgctcatcttcttgagccttaattgcatcatcgaaagccgctttcacttcctccggagggcgagcagactggaagttcacatcaatcacttctaagcccatatcataaacagcaatgatatcatttaaagttttccaagtattttcacgtacaactgaacgtccggtagttaaaatatcatccatcgtcatatgaccaattacataacgtaatgcactatctgtcgcttgatttaaactgtcatccgctctcgttacactaaacaaatatttcgccggatcttgaacacgatattgcaccgtcatctcaaccttaaccatattttcatcttgcgttaacattgaaccctgtgttcttaattcacgaacccgctcaacattcaccgctgttacgctatcaataaacgttggtttccaatttaagcccggctgaacgattgaatgtaattgtccaaaacgaagaactacaccacgctccgcttcttttatggtataaaacccgcttaatccccaaatcaccgcaccaatcaatacacctaacggtaacaatttacctaaccccaccggagaatttggcttgccgttttttccgacattaccggatttaccactgatttttttcagcaaattattaaagatctcttcaatatccggcggtgattgttgagtattcttttgttggttattcggctgctcccaatttgactgtttatcttcattatgggattgattattttccggttttttccccgtgctacccggcttaccccaaggatcttgatctgaattattgaacgacatttcattctccatttgtcaaaaattgtgacaagtctaaacaaaatattgatctaagtctaatttatttaaaactaattttgcgatttatttggtattcctcacacaaaagcaaaaaaataactcatttttcaaactctgtaatgataatcaccgcacttagaggtaacaacacagaatgatgaaaatcacctttcaaacgaatggataagaacaaaaaatagttatttaatagcaaaaaattcagaatgagaaagttattcagaagtgataaaaatcgccgaataatcggcgattttgtataaaatgaatcaatctaaccgtttagacatagctaaccaatcggctttaaattcacgacgcatattattaattgcatcaataatatcatgatgcaccaattgttcattttggataccgacacaataaccacctttgccctgtaataaaagatctacagcgtaaacccccatacgagaacctaaaatgcggtcaaaagcacaaggcgtaccgccacgttgaatatggcctaaaatagttgctcgagtttcgtgttttacacgggcttcaatttctcgagccagctcattcacatcacataataattcagtgatggcaataattgcatgacgcttacccttaataatggcacgctcaatttgcttaattaattcttcacgattaaattcaatttcagaagcaacaatatattcacaaccacctgcaatagccgccgagatcgtcaaatcgctacaatgtctgcccataatttccacgatagaaatacgcttgtgtgaacttgaggtatcacgtaaacggtcaattgcctcaactgcggtttcaagtgcagtttgataaccgatagtataatcagtgccagcaacatcattatcaattgttccaggaataccgacacaaggaaaatcatgttcttcagtgagtaattttgctcccatataagaaccgtctcccccgatgacgacaagtgcatcaataccatgtgaacgtaaaatttccacgcatttttcacgtacggcaggatctttaaactcagggaaacgagctgagccaaggaatgtaccgccccggttgataatatccgatacgctatagcgagttaattgttggatcttgttgtgatataaaccgtaataaccttcataaatcccataaacttccaagccctcggataaagccgaacgaacaacaccacgtatcgcagcattcatccccggtgcatcaccgccacttgttaaaactgcaattttttttatcatattacttacctaatgtattgttaaaattaatcttcaaaaaaacagtgccaaggttacactattccttgccgtcgctctataaaaatttttgtgaattgcaacacaatttgatctagtttaaatttttcagctcaacttgaacaacgctggttggctcttgatgaatcgcaatatcagcgtaagaaaatcgctgtctcaattgattttctatatcttctgtaatttgatgagcttgaagaaaagacatatgatcatctaattctaaatgaaattggataaaacgaaccgcacctgaacgtctggttttaagatcatgaaaacccaaaatacgtttatctgctaaaataatttgttctatgcttttaatttcttcatccggtaaggcaacatctaaaagcaactggagattatcaaacaagattttacctgcattaatcaatatataaaaagcaattaaaagagcaaaaatcgcatcggcttgttggtaacctaattggctcaacgataatgaaattaaaatagtaaaattcatcaataaatccgtttgataatgaagtttatccgctttaattgccggactgcctgtttgtttaatcactttgctttgatatatcactaacaatgcagtagctaaaatcgaaaataaggttacaaaaacaccaatctgaaaattcatcaagggttgtggtgtatttaagcgatgaataccttgcagaagaataaataccgccgatccggaaataaatgcactttgccccaaaccagcaagagcctcagccttaccatgaccaaaagaatgattatgatccgccggcatcagtgcaaaacgcaaaatcagcatattcatcaaagacaccaataaatccaacattgagtcagtgatagacgctaacatactgacagaactcgtttgccaccaagcgaaacttttcactaaaattaataataaagcggtaaaaatagctaaattggctgcttttttcacttgttgggaataaatacgttccatttatacaattgccctcattgataacaaccgactattttatattgttcgagctgtgcgatttctttatccacaatatatttttttaaatagcgttcaattttacgtttactcattgctgatatgggagctttcattaacttaaaagaatactgatattgaacaaaaccacaaaaaggaacctctttaccttttgcaatatctacttgccaagttggatttgtttctgtcggttcataaatcacaaagctgtaaagctcattatctttcaaataaagattaaattgcttcacaccgttattctgataaacatgtcgtctcaatgttatacgatccgacaaactacgtttttcacgattacgatcatgtaataattcaaccgcactttgccagttttcaacagtatgctctttcggtaaataaaagtaacgagccacagtttccaaatctaccgcactgacaagataataacttttttcatgatgcttaatatattccggtacgtttactcgagagtgtgatacacaggctgacaataaaagtgcggtcaacatagctaagattttgttcatttaattacatctcgcttaaatacaaattccgtttgtgttgaagaggatggattaaactgatacccccctaaatcaaactcttttaattgttcaatgtcagtgactcgatgttgaataatatagcgacacatcaaccctcttgcttttttagcataaaaactgatgactttatattttcctcctttgttatcaaggaaaaccggcttgataattttcacttctaattgattttctttaatggatttataatactcatctgaagccaaattaacgagaattctatcgccctgctgttcaattgcctgttgtaatgcgtcggtgatgatatttccccaaaaagcatataaatccttgcctttttcatttgccaattttgttcccatttctaaacgataaggttgcattaaatcaagcggtcgtaacactccatataatccggataatacacgcaaatgctgttgtgcaaattgaatatcgtcccgacttaatgtttcaacctccaagccggtgtaaacatcacctttaaaagcataaattgccgcacgagaattttgttcattatgctctatttgccattgttcaaagcgtacgacatttaagccggcaagtttatcgctaatcgacattaacgaacttatttgtgccggtgaaagttgacgacaaatgtttatcaatttttcgctatatgcagttaagtgcggttgagaaaaagcaaaattcggtaccacactttcccaatctaacgttttggctggagaaataatagctaacatgttctttcctcaaatttatatcgtcattggcaattgccaattaatttcagttaaattgtgatgtcgtaaatactgattagttttggaaaaatgcctacaaccgaaaaatcctctatgtgccgacaatggcgaagggtgtggcgaggttaaaacacaatgcttagtgcggtcaataaattgaccttttttctgagcatgactaccccaaagcaaaaaaacaagatgatcacgttgttcatttaaaacatgaataacacgatccgtaaacgtttcccaaccaaaattcgcatgtgaatgtgctaatccctgttcaacggtcaacaccgtattgagcaataatacgccttgctttgcccaaccgaccaaatagccatgtgaaggagtttgaaaccccataatatctgttgagagttctttataaatatttaccaatgaaggaggcggtgctatgccgggtttgactgaaaatgccaacccatgtgcttgattgacaccatggtaaggatcttgacctagaatgacgaccctaacctgatcaaactccgtcagtctaaaggcactaaatacttcttcttgaggtggataaattgttctaccgctttgtctggcttgttgaacttgctgtaaaatatgctggaaataaggttgttgtttttcgtgcccaattgcctctttccacgtattcatgattttcctcatattgatatgccaatcttaagcggcaattataaagaaagaataataaaatgcctagtttggatttgcttaatacgtataggttatttttaaattttgctgattttaacgccttgattacgtttcaatccaatatattttttcaataaaattaaaccgctctatatcaaattaattgaaaatataaaattttttgataaaatttgcaccagttcaattcgtgaaaaaacataatgattaggagcatattatgattaaaggtatccaaattactcaagcggcaaatgacaatttattaaactcgttttggttgttggacagtgaaaaaggcgaagctcgttgcttagcggctaaagcggaattcgttgaagatcaaatcgtggcagtaagcgagttaggtcaaatcgaatatcgtgaattaccagttgacgttgcaccaacaattaaagttgaagggggtcaacacttaaatgtgaatgtattacgtcgtgaaacattggaagacgcagtaaataatccggaaaaatacccacaactaaccattcgtgtttccggttacgcagttcgttttaactctttaacaccggaacagcaacgtgatgtaattactcgtactttcacacaaagtttataatttccatctgatctgatgtgccgtattcccacatactttaaaacgtggaaatacggcacaaaatattctcgtcgactttactctccgatcttaccttattttttattgcaacaccgaaatgtctgctacttgtaaaaagagattttgtagcgtgcttaaaatcgctaagcgattttggcgaagcgtttgttcttccacatttaccattactccgtcaaaaaacgcatcaatcggctgacgtaaattcgctaatttatccaatacagccgtgtagtcgccttgtgcaattaacggttgcacttcgccttttaaggcaataaccgcttccgccaacgttttttctgccgactctacgcaaacgcctaaatcaatctcaccaatcgcaatatcggctttcgctagaatgttgctcacacgtttatttgcggcggctaaggcttcggcactgtctaatgtacggaaatgagaaaccgcacgcacacgagcatcgaagtccgcaggtttggtcggacggcgagccaatacagattgaatgacgtctactgcaatgccttcactttcataccatgcacggaagcggccaagcataaagtctactacttcatcaaccacatttttattcgtcagtttgtcgccaaaaagtgcggtcgcttttgccacaatgtcaactaaatccaacggcaagtttttctccacaataattcgcagacaacccagtgcggcacgacgtaaagcaaacgggtcggcactgcctttcggggattgtccaataccgaaaatccctgtgagcgtatcaattttatccgccaatgcaacagaacaagcgactaacgaattcggcaatgtatcaccggcaaaacgtggcatatattgttcgttcaacgcaaccgccacgtcttcatcttcgccatcgtggcgagcatagtgcatacccattacgccttgcgtatcggtaaattcaaacaccatattggtcatcaaatcgcattttgagagcaagccggcacgtttcgctttcgtttgatccgccccgatttgtgctgcaatttctcctgctaaggcttcaatacgagcggttttatcacgcaatgtgccaagctgctgttggaataacacggtttcaaggcgtggcaaccgatcttccaatttctgttttaagtctgttttgaagaagaattccgcatcggtcaagcgtgggcgaaccactttttcgttaccttcaataattttgctcggatcgtccggattaatattggacacgaagataaagtgcggtaataattttccgtctttatcataaatcggaaagtatttttggtcgcctttcatcgtataaaccaaggcttccgcagggacggcaaggaaacgttcttcaaatttagcggtcagtacattcggatattcaactaatgacgttacttcttccaacaactcttcttcaatatccgccacaccgccaagtgcggtcgctttttcttgagatgttgcaaggatcaacgctttacgttcattgaaatcggctaccacagaaccacgttctttgagcaattgcggatattgatcggcgtgatcaagactaaattcacgctcacctaaaaaacgatgtccacaaacggtacgcccgctcgccacgcctaaaatttcgccttcaatcagatccgcaccgaataaaagcgttacggtatgcaccggacgtacaaactgctcggttttatcgccccaacgcattgtttttggaattggtaatcctgcaagggctttatcaataatgcctacaagcaagtttttagtcggctgaccttcaatcactgcacgatgcaccagccattcgcctttatcggtggcaagacgttcggcttgctcaacggtaataccacagcctctcgcccagccttccgccgctttggtcggcttaccttcggcatcaaacgccgccgatactgccggcccacgtttttcaacttgtttgctcggttgagcctctgccagccccaacacttttactgccaaacggcgaggggctgcaaaccattccactttctcaaaagccaaccctgcttgatttaactcttgctcaacattctccgcaaatgcggtcgctaattttttgagtgcctttggtggcaactcttctgtgccgatctcggcgaggaagttttgtgctgtcattgttatttctcaactatacgttttatttaaatccattggctaaacaaattgctttgttcgttttttggggtacttttactcaattcttcacatcgtttttacgtctaccaaataccctaactcaataaaaatcaaaaggttccgttttacttgatatcgttttgaactcattttcttattctacactattttagatagaggcaaaacaagattgcttttgaaaacgctcaatttgccttttcgttgtactgcgttttaacgttttaaaaatcaatctaaactcatatcaaagtaacccagacaagaaaaagaaaaagaaaggataaagagaagagaagaattttattttttttgcgataaatttagacaattttgtagcaaatttataactagatcagtataatcgcacacttaactaaactggatttaatcatttgagaaaatagctcaaatcaaccctattaacattaatcgaataagaagcagaatatgagcctacagcctacagcctacagcctacagcctacagcctacagcctacagcctacagcctacagcctacagcctacagcctaggctaacgcctttttataaaccttgcaaaataaattttaaaaagtttttaacttctcgtcatacccaaatttccccttttaaccccctttgcgaaaatatcattcgcctttttttgctttgccttaaaaagcaaggtattgcctatttagggttatcccctctctctaaagtttaataaataatcagtaagagataataaataaacaatcaataacagattcgatcaataaccatttaacaagtcattcaaagataatttttaaagcgagtaattctatgaacaaaatatttaaaaccaaatacgatattacaacaggtcaatgtaaagctgtttccgagttggcaagcaaccgccaaatagcgagcagttcgaagagtaaatcaaagtgcggtgtgtttttgggtggaattttaggggcgtttaaggtcctgccgttggcgttgktrmtkgcrggrttttttgggktgagyagtrtttcwtacgctgctrtwrtatatattgatatggaagcaactacaggtgctgctggagtaagacaagattggagagaatcacaatattggaaaaataaaaaaaatattttaatagcacctgttcaagataggggtcaaaatttaaaaaggtatggtggaataaatacaagggtacaaaaatctgtaatcataggtcctannnnnnnnnnnnnnnnncataaacaaggtatgactgtattggggcatggagcagttgggtacgaaagccaagcgacagctttaggaaacaatacatatgctggaggacaagccacagcaattggttctgatgtaatggcaggaggacttgcctcaatagctataggaaatgatgatatatatactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagatcaaaatgagtttaagaaaaaatatgttagaaatggtcatataaatactaaagtatattccccaacatatgcagccggagtggcagcaatcgctatcggttcaagatcggttgcttatggtgatacttcactctcaatcggtacattatcatttgcattaggcaatagatcgactgcggtcggctttcgtgcgtttgtggattttgccgcagaaggcggggttgcgatcggagatgaatcacgggtatttgccgcgaattcctttgcagtaggaaataatgccgaatcaacgaataaaggggcgttatcctttggtagtttctcaaaagcagtaggtgagggttctatcgctataggacaaaatgtagggtctaatgccaagttaagtggtagtgctgacaccgaacttgaaaagttgattatgagtactacacaaactgctcaacctaccgtatcccctggggatcatggaagtgcaactattgcatatgacaatagctcacctgataaacaattaaaattcggagataagaatgagattgttacacttggatttgctgcaaaaaacaaaacagaaaatccagtttctaagctaattgataaggtagtaragaaaaaaaacaagaaaaaagatcagctacaatatgcttttgacaaaagcaacggcgaggtcatcgaaaccactgaaaaaatttataaaactcaaaaagaaggcgaccatgcgatttcgctgggctatcatatttccaacaacggcgataatactattgcgatcgggagtgcttccatcgtcagaggatcgaactcggtcgttttgggggcattaaataacatcggtaaatatgcacgaaataccatcgcacttgggattggtactaatgtatataaagaaaactcggttgctatcggtacgggggtcaatgttgccggtgcgggggttgtggctatcggttccggtgtgggggttacgaaagataacaccatcgccgtcggctatggtgctcatagtttatcgggcgaaagtattgttttaggaaatgatgcaagcctaaaagaccatgcttccaaatctatcgtcatcggacaccatgcacaagttgagaataaacttactgagccagataaataacagaaaatagaaaaagtaaaacaagataagaagatatttttaggtggcgacaatgtagaattagagatgtccgccattgcgataggggcagactcaaaagtttatgctgaaaaaggcgtagcattcgggaataatgcacaagttaaggaaactgctagtagtgcaatggcattaggtaatgatgccgaagcgacgatgcaaaactccgtggcgttggggtataaatccaccaccaaatatttttatgaggacaaaacgggcaatactgcaactattacctcatcaaacggaccaaccgttaaaaatgacagctctaccaagaccgctacgttaggcgggaaaaaagctattgagttagctccctatattccggaggggtcaagttacgatttaaaaaccgatgaagcggcaggtattgtgtcagttggttggataaaaaatggaagtaatggtagcggtcaagaacttggattgagaagaattgtcggcgtcgcaccgagtgcgttggattctgacgtggcgacgattgggcaattaaaagccttagcttatgtgaaaaaagagggcgtggttacctactataccgaacagaacgggaagatatataaagtcgttaaaaatcctgagggtaaattctttaaagtcaatacggacaacggaacaccgctcgatgataaagaaattgataaaaacaaagtttttgccggtcctaaaggggcgaatgaacaacctgtcatgataaatggcaaaaaaacagcggatatgggcgaactaattaaatttggtcatatcgccgatggtaatattgccgataaatccaatcaggcgattacgggcaatcagcttaatcagcttggtaaaactattttaggcttgaccgtaaatagtgataaaacaaaatttgatacgcctagttttgtagcggttaattatgaaggagcacaatccggaacaaataaccagccaacaacatttaaaaaagccattgatgaactgattacggcagtaaataaagggcttaacattgcaggagatgatgcaaacggacaacttaccctaggctcaactttaacgattaaagcggggaatacaacggttgaggataaggtactcaaaacaacaacagaatataaaagcgataatattagaacagcctatcaaccgactagcaaaacacttttaataggcataaaagaaaatccgacatttaaaaaagttacattgtcagaagaacaaacctatccttctggtacacaaaaaaataaggtcggtaaaaacgacttaattactaaaggctatttagacggtgcattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaatgtcggcaatgggtctaccaacggcgataattcctttgcgttgggtaaaaattctacatgggaagggaaaactaccgctgcgaccagtgcagatattaatgtgggttcagcaagtttgaaatttgactggaacaatgcaggagcaggggcggataaagaagttgtcagtgtgggtagtcaaggcaatgaacgcataattaaacatgttgctgctggttctgttatgcctaactccactgatgcgattaatggcggacagttgtatagcgtgattgaaacatttggtaaattaggcgttacagtattaggtgcggaagtggatagcggtacaaaacaattcaaagcaaccacatttaccaagttgaaaaatgaaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatacaaaacgccgaatgggcaatctccatcggtaataaaaacaacgtttcaggcggaaatgatattgtcgctttggggtcgaatattaccatttcaaaaaataatggtaagcgtaacgattctgtcatcgctataggaaatggagtagagttaaaaaatgcactacaatccatcggtgtgggtagggatacgaaaatcaccaatgccgaatgggcagtcgctatcggtaataacaccaaaattacgaacggtaatgacattgtggcgttggggtcgaatattgaggtaacgggaagtaataatgatagcgtactcgtattcggtaacggtgccaaagcagaaagtgcagaaaattccgtggtgattggtagagaagcagagtccaaagcacaaagtgcggtggtactcggtaaaggtgcgaatgttaagcannnnnnnnnnnnnnnnnnnnnnnnnnnnnnnngtgcgacagttgaagaaaatgctggcgattctgtggcattgggtaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaccgtagtcagcgtaggggataagggtagcgagcggattatcaccaacgttgccgcaggtaaagtcgaaaccggctcaaccgatgccatcaacggcggacagcttgcggaagtgattagcgtttttggtaaattaggttttgatgtacttggtgcagagaaacatgatagtgaagatggttttaaacaatcnnnnnnnnnnnnnnnnnnnnnnnnnnnnnnnnnncaaggaacacagcaaggaacacagcaaggacaaataaaagccccaacaacctttagagaagctattaatgaaagcattacggctattaacaagggcttgatgttcagagcggatcaaagtgcggtaacaaatggcactcaaaacacaccgcactatcttggttcgacccttagcattgtgcgtttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaccgcacctactacggctgttgttactatagcgacgactgacacgttagaaaatataaaatctatctcctcacctaaaggaagtgcggscggaaatggtgccarttcaamtggagaartcacyaaacttactttagatgcagaaaatgcsacattccaagtcggtacaacgggtgcgaaagtgaatatcaataaagagggtatttcactyacaccacaaggggcgaatannnnnnncggagcaaatggagcaaatccatttgctgatacagcatcaatcactattaaagcaggtgcaaaaccggcggatccaaaaagtttagannnnnnnnnnnnnnnnnnnnnnnnnnnnnnnnnnnnnnnnnnnnnnnnnnnnnnnnnnnnnnnnnnnnnnggcacaggmaaaatcaccggtctgaaagatttagaagcaaattctgacggcacgagtgcrgtgaataaaaactatgtggataaactggataaagtgacggtgaaatatgatgatgaasataaaaaatcaatcactttaggcggtaaacctmaaaatggaggtaaggctcatgaccctgttgccatcaamaayctmaaatccggtttagggcttgatgatatgaaagataaaccggattctcaaaaaaatggattaagtcttgagctagtgaaaaaactggtttcyracggyatragtagycagcaaggrcaacaaatgacaaaagatgaactrcaymaagccgcyaatctcgctgatttraaagcggttgcacaagcwgggttgagatttaaaggaaatcagggcgatgatgtagtcagaaraatcagcgataccttaactattaaaggggaagaaaacgctacaactggttctagtgccactgacaagtttaacagcaatactaccgccgctggtaanattaaggtagaagccaatacagccaaagatggtttagaaataaaactgtcggatacgttgaaaaatatgaaagcctttgaaaccaaagaggagagcggtaagaaatcgacgttaaatagcgagggcttaactgttgagaacaaaggtaaagatggcaatagtaaaggtacctctgccacctatggtgcggacaatatcatgttggaagataaaggtaaaaacaataaagcaacaataactgctgaaagccttacctttgctgacaacgtagcacaaaatcagcaaaatccaatgccaaaaaccgttcttaataaaaacggcttaaccgtaaccggcaaaggcggtgaaattaagattgatggtgaaaacggtattattaccgtaccggatattaaaccaacaaccagtggaagtgcggtggtgaataagaaatatgtggatggtcaactcagtgccgctgtcaaccgcttggataatgtgatcagtgccaacaacaaacgcttgcaatcaggaattgccggtgcaaatgcggcggctgcattgccaacgattgcgatgccgggtaaatcagcacttgcagtctctgcgggtacctatagagggcaaagtgcggtggctttgggctactctcgtgtgagtgacaacggtaaaattatgttgaaactacacggcaacagcacctcaaccggcgatttcggtggtggtgtcggtatcggctgggcgtggtaagctgaggtcaaactatcaaaaaaagcagtgataatctgttccttggtcagttgtttttttaatccaacttctaggtgaagatcagaatcactgcttttttgtttgttggtgcggtatttgcctgagagcaatgcatgataaaaaatagtcagttaaatactgaataacgatgccataatgtataggtgaaatttcgagataaaagcaaaaatctattacatcatttcattactaataaatttagcgtaaaataatgccatctataattacatagcagaaataaaaatgagcctacaagcctacaagcctacaagcctacaagcctacaagcctacaagcctacaagcctacaagcctacaagcctacaagcctacaagcctacaagcctacaagcctacaagcctagtatattggctaaaaacaaccttgcaaattcattatgaaaggttgttaatgtctaaacaaaaatccaagaccaatcaatctcaatctattactcaaaatagttttcgtttttttgatgcctataaatcattcatagatttaaaagattgttgtttatttctcagaacgaacgatatcaatactattggtatgtttgcagttaatgtacttgcatttcctcacaaaaaaacaccgcactaaaataagatgttccgagaagataatatgaatttaattatatgctgtactccattacaggtaatcatcgccgaaaaaattatcgaacgttatcctgagcaaaaattttatggggttatgttagaatcattttataacgataaatttgatttttatgaaaataaattaaagcacttatgccatgagtttttttgtataaaaattgcaagatttaaactagaaaggtataaaaatttactttctttattaaaaattaaaaacaaaacttttgatcgtgttttcttggcgaatatcgaaaaaagatatatccatattattttaagtaatatctttttcaaagaattgtatacttttgatgatggtactgcaaacatcgccccaaatagtcacctctatcaagaatatgatcattctttaaaaaaaagaattactgatattctattacccaatcactacaattccaacaaagtaaagaatatatctaagctacattattcaatttatcgttgtaaaaataatattatagataatatagaatatatgcctttgtttaatctagaaaagaaatatacggcacaagataaaagcatctcaatactattaggtcaacctatattttatgatgaagagaaaaatattcgattaatcaaagaagtcattgcaaaatttaaaattgattattattttcctcacccaagggaagattactatatagataatgtttcatatattaaaacaccgcttatttttgaagagttttatgcagaacgatctattgaaaataatattaaaatatatactttttttagtagtgcggtattaaatatagtaaccaaagaaaatattgaccgtatctatgctttaaagcctaaattaactgaaaaagcatatttagattgttatgatatattgaaagattttggtataaaagtgattgatatttaaaatttttggcaaaaaaaaataaataaatgatcttaaattaatccgtaataatgaacttcattattcactttataaagcaagctgaggagtaaatgttacggtaagttcaaccagttcatctaaagagattattttcatttgcggtaactgtacaaatattttctcacttaaatttcttgcctcaacatcaggttgtaaaaacataacaggtatattaaggcaagcaaaaagttgagggtgctttaagggtaataaaacagcatcttgccataaaactaatacatcttgtggtgtgatttggtctaaataaccggttaattcatttatgtcgtagcttgattgagaaaaggtatagagcatattatttatccctaaaaagttaaaattttctctgcctgatttagtttttgtagcaacaaaatgcggtcaattttttgacaggaaataataaaatcttggctatttaattgatatttttcacaagattgccgacaaatataacgttgctcgatttcatacaaatccaataatttaaaggtactaatgaaatctttttgcaaaataatttcaggtttctgctgattaagtaaattaaaaacaccatcttctaagaagaagaccgcaatttcatcttcattacaaaatgccgttgccgccaacagtgcatctaaaccttctcggctgatactgctaccgtgtggtgcttggcgaaagataaaagccagttttatcatattgttatcaacctatctgcttgcaaaactgccttattaaactctcctaatcctgccaaaataaaaccttctgctaaattattttgttgctggttatttgaactcagcggttcaacgatacctcgccgttgtgctgctgaaatacaaagatgcaatgggatagaaaatgtttgactcaattgttgccacgctttttgtaaatgaaattcgtcatttgccggattgacaaaggcattacctaaagttaccccttgttgaaaaaaaaagatttgttcaatttgatgacctttcgccaataaggtttgtgcaaattgataagcaagatatgccccttgtgtaccataaacaggctgtttaaccgctaaaacataacgcattattctattccttgctcttgtttgagttgacggatatagagataaacggtatgtcgagagatatttaagcgttccgctactaaattaatcgcatctttaatatcaaaaatacctttttcatataaggacaggacaatttgacgatttttgttatgatttgcaacaagacgatccgctgtaatttcttcgatagtttgttctatagtttgaacaacaagctcctctactgaactggcgaaattaactgctgacatttccacttgttcaggtgcgggcatcaatgcctgaataaattgagacatgggaatatccaaattaatattaatgcaaagtaagcctataatgcgttgattaccgttacgaattgcaatcgtcaccgatttcatcaatcccttacttttagatcgagtaaaataaggtttagacacactctcggtttgcatattgtgcaaagacgttaatgcaaaatttgtaatcggcgaccccacttggcgattggtattatgtccattggcaatacaaatagccgaatgctcaaggtcttccaaagagtgtaaaacaatttcacagtgctcaccaattaatgcactaatcccctcaaccacagcgatataagaattgagaatagtatgatcttcatttgtaaaagggcgtctatccgataacatgcttaatttcccttatttttctcaccgcactttaggctatttttaatgtaagtgcggtgagttttactttatttttcagaagttacatctaagatttcaatatcaaaatatagcgttgaactcggtggaattaggcctgcacctctttcgccataagctaagtcggcaggaataaccaactcaatttttccgccttttttaatgaattgtaaaccctctgtccaacctaaaatcacttgatttaatttaaattcagcaggttgtccacgctctctggaactatcgaatactttgctattggctaatttgcccgtgtaatgtactttaacacgatctgtcggtttaatgctcttaccttctcccattttttcaatacgataaagtaaaccgctttccgtttttttcacattcgattttttagcaaattctgctgtaaatttctcattttcagctttgattttagccatttttgcatgacgtgctttgttttctaactcttgcaacgtttcttgtgctttttcatcagttaaagtgcttttattttctacaacatctttaatgccagcgacaattttctcataattgtaactggcaacatctttgtgttcttcacccatcaccgttaaatattttcccataaaatagcccaaagcataagaaacatcatcattgaactgcttatcagcaaaaacagattgagaaatgaccgcacttgctattaacgctattgcagaacgttttttaatttttaacatttttcttgatcctttataataaaaatatgaaatgttgaatagattaaattgtcttgttcaaatgcacaatcattattttttaattagagactatttatgccacaaactcaagaattagatcaacgtattgcagaattagaaatgaaaattgcctttcaagaaaacaccttagaagaattaaatcaggcattaattgatcaacaatttgttttagacaaaatgcaactacaattacgctatatggcaagcaaattaaaggatttacaatcttctaatattgcaagtcaagcggaagaaacacctccgccacattattaacttattgatacacatcaagaatatcaataggataggttttttcggataaataatcttccacggcttgtaataccaaaggattgcgagccgcttgtccatcttgctgaatataatggtgaaactcctccaagctcaaccaaagccctccggaaatatccggatcagaaggtgttatctcaacccaatctgttaactcaacagaaaaaacaaaacgtaaataatcagttttagaacgaggtgcatgccattggtaaatctttaataagttttgcatctctgctcgaataccggtttcttcaaataattctctttgtgcaccttgtaaaatagtttcatttttttctagatgcccagctggttgattaagcgtcattttgccgtattcaaattcttcgacaaataaaaatttgcctttgcagtgcacaacacaagccattgtaatatttggtttatacatattagatactctttttaacttgttgatataaatcttgtaattcggttaacgtaagctcacgaaattgtccattggctaaattggtgagcgttagccccgctgtttcataacgaattaaacgcaatgtgggaaaaccgatatgggcagtcatacgtcgtacttgacggttacgcccttcgctaattttaatttccagccagctggtaggaacagttttacgctcacgaatcggtggatgtcgttgccaaatattcggttcagaaatcaaccgcacttttgccggtttggtcaatccatcattcaattcgatgccttttctcagctgtgcaagatcggtttccactggaatgccttctatttgtacccagtaggttttttccattttaaattttggattcgtcagtcggtgctgtagctcgccattattggttaacaataaaagaccctcgctatctcgatctaaacgtcctacgggataaatgtgcggtatttttataaaatcttttaatgttgcccgcccttgttcatctgtgaactgacagagaacatcaaaaggcttgttgaataaaatcactttagtttgtgcaaagttaagtccccttttttgcctacgtttcagcaccgcactttttacaagcgattttatcaagttagtgttgtttaattttttgcgttgaagatccatgttttagataaaaataaataagggcaagccattagctgcccttatgctgattagatttttgccaaaatattattcaatgttgctgaaggacgcatggcttgtgctgtagccttggaatcagggtgataataaccttgaatattttgcggcgtcccttgtgcagcaagtagctcttgattaatttgctgctcattttcttgcaaggcttgtgcaattgactcaaacttcctattaagttgttcatctttgttttgcgctgctaaggcttgagcccaatacattgccaaataaaaatgcgatcctctgttatcaatcgtccccaatttacgtcccggagatttattcttatctaagaaaattgcatttgcctgatctaatgtttctgccaaaatttgtgcttgatcgttattttgcgtttgagcaaggtgttccagtgaagcttgtagtgctaaaaactctcctagcgaatcccaacgtaaataaccttctgcaataaactgctcaatatgttttggtgcagaaccgccggcaccagtttcaaataaccccccaccattcatcaatggtacaattgaaagcattttggcagaagtacctaattctaagattgggaataaatctgtaagataatctcgcaacacattaccggtagcggaaatcgtatccaacccttgacgaatacgatttaatgaaaatttgcaagcctcaatcggagataatattttgatgtctaaatgtgttgtatcaaattcagccaaataagaccgcacttttttgataacttcacgatcatgtgcacgattttcatctaaccaaaaaacaaccggcgtattggtaacgcttgctcgattaactgcaagtttaatccaatccttaattggtgcatctttcgtttgacacatgcggaaaatatcgcctttctccacatgttgcaccaagtaaatttcgccatcttcaccaaccacttgaattaccccttgctcttcagcttggaaagttttgtcatgtgagccatattcttccgctttttgtgccattaatccgacattaggtactgaacccattgtagtaggattaaaggctccgttatgtttacagtcttcaatgaccgcactataaatccccgcataacaacgatccggaatgagtgccaaggtatcttgtaattccccttttctgttccacattttgcctgaattacggatcattgccggcatagaagcatcaacaataacatcagaaggaacatgcagattagtaatccctttatctgaatttaccatagcaatatcaggtccttgctccattgctttttcaattgccgctttgatttcattttccttagcatggccggcgattttgctataaagctcacccaacccattgttcgggttgatgctaagttgagtaaacacatcagcatattgtgcaaaaacatcggcaaaataaacagaaacaataacaccgaaaatgataggatctgatactttcatcattgttgctttaagatgtgttgaaaataacgtaccctccgctttagattgagcttttgcttgtgctacaaaatcttttaacgcttgtaaactcatcactgaggcatctattacttcaccagcttttaacggtgcaaattttttcagcactttcttttcaccgtttgcagccacaaattctatttgaaattgtcccgcactttttaccgttacggatttttccgtaccataaaaatctccttgttgcatgctgacaacttgggtttttgattgtgcagaccaatcgcccattgagtgcggatttttctgtgcataatttttcactgcttttggtgcacgtcgatcagaatttccctcacgtaaaacgggatttaccgctgaacctaatacttttgcgtaagccgcttttatttttttttcttcttccgtctgtggttctgttggatagtcaggaacagcaaatccttgttgttgaagttctttaatggcggcgttaagttgaggaatagaagctgagatattcggtaatttaataatattagcttccggtttagtcgccaattcacccaattcagcaagggcatcaggaattttctgttcctcactaaggtaagcagataaattggctaaaattcgccctgcaagagaaatatctttggtttctacatcaatatttgcgacagcagtaaatgcttgcacaattggaaggaaagaataagtcgccaacattggtgcttcatcagttaatgtataagtaatttttgctgacataggcatgttcctgtatagatatgaattggttaattggaatgaatttgctctttatggtattagagcgttctaagcataacaaaaaaataacaataatgttattttatgcgtacaattttttcaaaatttaaacaatatctggaaagaatatatacagataaatgatatttatgtcataatccgagcaatttcgttttttattttaggagctattatgtcaaaaccattaaattttgtgatgatttctccacattttcctgcaaactttgaaacttttgccgttcgtttaaaggagtgtggttttaatacattaggtattgcagacacaccttatgaacagttaagtgaaaacttgcgtaattccttaacggaatattatcgtgttgataatatggaagactacgagcaagtctatcgtgctgttggttattttgcacataagtatggtcgaattgatcgtattgaatctcataatgaatactggcttgagcttgatgcaaaattacgtacagattttaatgttcccgggtataagaacgatgatatgttggcaatcaaaaccaaagcacaaatgaaagaaatttttcgtcaagcaggtctgaaagttgctcagggaaaagtatttaactctgatgatgaagcacgtaagttagctaaaaaattgaagtttcctgtgattattaagccaaattcaggagtgggtgcaagcgatacttataaaattaagtcggtacaagaattagaggactttttttcttataaaaatgcacacgttgaatacatcatggaagaatttattgatggggacattattacctttgatggtttaaccgataaagagggcaatattgtgttctattccggtcttgaatattccgagtgcgtattggataccgtagaaaatgataatgatatgttctattacgttcctcgagaaatttcaaccgacttaattaaattaggacaaaaatgtgttgatgctttcaacgttcgtgagcgtttcttccattttgagtttttccgtgtgaaaaaaacaggtgatttgatgccgttagaaatcaattgtcgcccacccggtggcttgactattgatatgtggaattatgcaaatgattttgatgtattcagagaatacgccaatattgtgaaagaaaataaattctacacaaatattacacacccatggaatgtggtatatatctcacgtaaagcaaataagaattatgtaaactccattgaagatgtgcaacaaaaatattctactaatattattagtgtgcaaaccgtacccggcgtttttgccaaaattatgggggaacatggtattttagctcgcacagaaactttagatcagatgcatgaaattgcacaatttgcacaacaaaaagcataactttgttttaatttatagacaggatttccctgtctactgtaacttttaggaaaaaaataaatgcactttgaaagacgtagccattggagcggtgaattgggacgtgaaatgcactttaatgtgtatggtcatgcgggtaagcctgtgattgtatttccttcatccggtggaaatcaaaatgaatatggtaactttggtatgattgaagcttgtcgttcttttattgagcgtggcttaattaaattttatacacccgactctttcgataatgaatcttggctggcagaatggaaatccggacatgatatggcacaagcacacaatgcttatgatcgctatattttaaatgaacttgttccactaatccgtcatgaatcaaaatgggacggagcaatgattgcgacaggttgtagtatgggggcattccatacaattaactttgctttgcgtcatccggatttatttgatgttgcaattgcattgagcggtgtttacgacgcacgtttctttactcatgaatatcatggtgattctaccgtttattttaactcgccaattgattatttatggaatcaacatgataactggttcttagaacgttatcgccaaaatcattatattgtggctgttgggcaaggtgcttgggaagaacaacatatagcggatacaaaacgtttagaagaagcatttcgcagtaaaggaatagaaggttggtttgattactggggtcatgatgtggatcatgactggccttggtggcgagttcagatgccatttttcctctcaaaattggaggaacaggggattatttaatcaataaaggaaaacattaaaatctatggagatctcaaaaaaccttactacggtattcatgttccttgtattggtcataatttatatgaaattgcttatcaggcaatcagtttagcggttcgagaaataaatgatagaaacaagatcatttctaaaattgtcattagaagtcggttgatagatagtaataaataaaaaactaaggggaattcagacttaaagaacaaaattagtgatcaaagcctagttaaacccttatcataaatacaagaagttaactaggtcagagacttttaatgcacattgcagtagtaatgatcttcaaaaatacgaccaaaattaaggctaaacaacgttataaatgaaaaagtgagcataaatctgctcactttttgatgctccaactacaattccttatgaattttagaattgtctttgtttatttaatggagtattacttaataatcttagcaacaacacccgcacctacagtacgtccaccttcacgaatcgcaaaacgtaaaccttggtccatcgcaatcgggtgaattaagcttactgtcattttgatgttatcgccaggcatgaccatttcaacaccttccggtaattcaattgtacctgttacgtcagtagtacggaaatagaattgtggacggtaacctttaaagaatggtgtatgacgtcctccttcctcttttgacaacacataaacttctgattcaaagtctgtgtgcggtgtaattgaaccaggtttcgctaatacttgaccacgttcaatttcttcacgttttgttccacgtaataatgctccaatgttttctcccgcacgaccttcgtctaataatttacggaacatttctacacccgtcaccgtggtttttgttgtctctttaataccgacaatttcaacttcttcaccagtacggataataccacgctctacacgtccggttactactgtaccacgtcctgaaattgagaaaacatcttcaatcggtaataagaacggttggtcaatcgcacgctcaggctccggaatatagttgtctaagtgagacgctaattcaagaattttttcttcccactcagcaactccatttaatgcttgtaatgctgaaccacgtacaattggtgtgtcatcgcccgggaagtcgtattgagaaagtaattcacgtacttccatctcaactaattccaataattcttcgtcatctaccatgtcgcatttgtttaagaatacgatgatgtacggtacacctacctgacgacctaataagatgtgctcacgagtttgtggcattggaccgtctgttgccgctaccactaaaatagctccgtccatttgtgccgcacctgtaatcatattttttacatagtcagcatgtcccggacagtcaacgtgtgcgtagtgacgtgtcgctgtatcatattcaacgtgtgaagtgttgatagtgataccacgtgctttctcttcyggtgcgttatcaatttggtcaaatgcacgtgcygcaccaccaaagtgtttggataatacagtcgtgattgctgctgttaaagttgttttaccgtggtcaacgtggccgattgtacccacgtttacgtgcggttttgtacgttcaaatttttctttagacacttttcagtttccttttattgagtccccaaaagtgcggtgcaaatttggggagttttgttgattaaataaaattattttttacgtgcttcaattactgcatccgccacgtttttcggtgcttcagcatattttaacggttccattgaatatgatgcacgaccttgagtttgtgaacgtagatccgttgcataaccaaacatctctgctaatggaacttcagcattgattttcacaacaaattcgtttgcttcttgaccgcttaccatagcacgacgacgacttaagtcaccaattacatcaccaacataatcaggtggagtttcaacttccactttcatgattggctcaagtaacactggatttgctttattaaatgccgctttaaatgctagagaagcagcaagcttaaacgccagttcagatgagtcaacatcatggtatgaaccgaaatgtaaacgaacacctaaatcaactacaggatatccagctaatggaccggatttaagttgttcttggatacctttgtcaacagctggaatatattcaccaggaattaccccacctttaatttcgttaacaaattcatatccaggaccttcaggttctagagggtataaatcaataactacatgaccatattgaccacgaccaccagattgttttgcgtgttttccttcaacatcgtttacacgagtgcggatagtttcacgataagatacttgtggtttaccgatatttgcttcgaccttgaattcacgacgcatacggtcaacgataatatccaagtgtaactcacccatacctgaaataatagtttcacctgactcttcatcagtgtgtacacggaaagacggatcttcttgagcaagacgccctaatgcaagacccattttttcctggtcagcttttgtttttggttcaacagcaacagaaataaccggttccgggaattccatacgctcgaggataattggtgcatccattgcacataaagtatcaccggtacctacatctttcagaccgattgcggctgcgatgtctcctgcacgtacttctttaatttcttcacgtttattcgcatgcatttgcacgatacgaccgaaacgctcacgtttgtcttttacagaattcaatacagttgcacccgattcaacaacaccggaatatacacggaagaatgttaaattaccaacgaatgggtcagtagcgattttaaatgccaaagctgcaaacggttcatcatcactggcatgacgctcaccttctgtttcatctggattaatacctttaatggcttcaatatctgttggtgccggtaaataatcaattacagcatcaagcatcgcttgaacacctttatttttgaatgctgatccacaagttacaaggataatttcagtttttaatgcacgtaaacgtaaaccttttttaatttcttcttcagttaactcatcacctgaaaagaatttatccatcaactcatcagaagattcggcagcggcttcaactaagtttgcacgccatttttcacattcagcaagcatctctgcaggaatatcttcataggtaaaagtcatcccttggtctgcttcattccagttgatcgctttcattttaattagatcaacaacacctttgaaattatcttctgcaccaataggcaattgtagaggaacagcattgccacctaaacgtgttttgatttgctcgacaacacgtaagaaattggcaccggtacggtccattttatttacaaaagcgatacgcggtactttatatttattagcttgacgccatactgtttctgattgaggttgaacaccaccaaccgcacagtaaaccattaccgctccatcaagaacacgcattgaacgttctacctcgatagtaaagtctacgtgtcccggagtatcaattacgttaatacgatgttgtggaaattgttgcgacatacccgaccaaaatgccgttgtagccgcagaagtaatagtaataccacgctcttgttcttgttccatccagtccatggttgcagcaccatcatgtacctcaccaattttgtgacttacacctgtatagaacaaaatacgctcagtggtagttgttttacccgcatcaatatgcgcactgataccgatattacggtaaagtgaaataggggttgtacgagccattattatttccttgtttggaataaatttaaaatatgaacaaggctccaccgcatagtaatgtgatgaagcctaaaaaacactttgctactctaccaacggtaatgtgcaaatgctttattagcctcagccatacggtggacatcttcacgttttttcactgccgcacctttgttctcagaagcatctgataactcattagctaaacgcaaagccatagatttatcaccgcgcttacgtgcagcttcaacgatccaacgcatacctaatgcgttacggcgagttggacgaacttcaaccggcacttggtatgtagaaccaccaacacgacgagatttaacctcaactgttggacgtacgttttccaatgcaatttcaaaagcctctaatgcttcttttcctgtacgttgagataacgtttctaatgcaccataaacgatagattcagcgatggattttttaccatctaccattaaaacattaataaatttcgcaagtaattctgagccgaacttcggatcaggaagaatcttgcgaggttcaatacgacgacgacgtggcattgtaatttctccgttttttatcttcaggattatccaaaactctttatgtaagaaatgacatcttacttttactggagtttatggtaattaatttgttaattagcgtttggccttacttaacggagaaccattaagctttaggacgtttaacgccgtatttagaacgactttgtttacgatctttaacgccagcacaatccaatgcaccgcgtactgtgtggtaacgcacacccggtaagtctttcacacgaccaccacggattaacaccacgctgtgttcttgaaggttatgaccttcaccaccgatataagaagttacttcaaaaccgttagttaaacgaatacgacatactttacgtaatgctgagttcggttttttaggtgtagttgtgtacacacgagtacacacgccacgtttctgcggacatgactctaatgcaggaacgttgctttttacaacctttttcacacgcggtttgcgtactagttggttgatagttgccattaataaaactccaatagtttttacaaaaatgtatatttaataatctatctatacaaagatagacgccgaattctaatcacacaaagtgatattgtcaagaattaagcaattctatcctgcaaaaataacgaaagattctatttagattgggtgaagatctatgctttaagtttctcaatagtttttttatcaaagaaataatgtgtaccacaacattcgcattgcatatcaatactaccgccatgttctgttaaaatattttcaatttcatcatcggaaatcaaaagtaatgcagatccagaacgctctaaagaacaaccacaatgaaattccaccgcacttggtggataaatctccacagtttcttcatggtataagcggtacaatagttcttctgcagtcaatccgaataattcttcattttttactgttgcagctaatgtcgcaagatgttcaaaatcctcttgtgaaccggtaccatcaggcatgatttgtaataataatccagcagcaacaggttttctctcatattcaccggaacgaatcaataattgtgtttgtagctgttccgaacgaatgaaataatcctctaagcactctgcaatggttggtttatctaatgcaatcactccttgataacgctccccatttgttggggctatagtaattactaatataccattgccgactaactctgataaggtcatatcatcatacacatcatcttgtaaacgagccaatgcacgaatttgttgactatcactgccgttaactaacaataattttaacggaccgttaccttgaatttgtatggtaatattgcctttgaattttaaagttgctgtcaataaattggtagcgaccatcatttcacctaataaattccgtacaatacgaggatattcatgtgagttaagtgtatcggtgaaagtcttattcaaacgtacccactcacctcgtacggcacgatctttaaataggtaacggtaaagtttgtcattatctgtttgatatatcatatatttttcctgtttattcaaattttcaatatctatcgtctttataaattgaatgctattcctgatacttaaacttcaataaatctctccgctcttttttatttggacggcgatccgggtgtggcatagaaagtgcattattcttacgtgcgattgccattttctctcgctgttcaacactcctagcggtttcacgatacaacaattgtgcttccggtgcaccacgacgttgtgcagatagggctagcacttctacttctttttcttcactaccttgacgcaatttgagtattgcaccaatttccaccgttttatttggtttagtacgttggttattataatgcacctttccaccgtcaatcatttcttttgcaatagtacgtgttttataaaagcgtgcagcccatagccatttatcgagccgaatactatcatctttttccttgggtaaatgctgttttgccatatttgtcttttcgttcagttaaaatcaggggtatgatagggggattaaagacatttgtaaaagggaagattatgaatgaattgaaaagtcgggtattactggacaaggttttacaaattgcttatcaagcaggagactatctcgatcgtttttatgacggaacgattgactttcagatcaaaacaaaatcggataatacgcccgtcacaaacgcagatttatttgtcaatcaatttctcatcgaaaaattgaccgcacttacaccacatatccctgttttatcggaagaaaactgtcaaattcctttttcacatcgtcgacaatggagtacttattggttgattgatcccctagatggcactcaacaatttatcaatcggacagatcaattcgctgttctcattgcattagttcatcaaaataagagcatattaggtattattcatgctcccgtattaaaacaaacttattatgctctgcaaggtcatggtgcttataagcaaactgaacattatctacaaaccttgtcagccagagagattgacttaaaccacagagtaaaaattgcggtaggttcaaaaagtgcagcacaaaaagtgcggtcagttttgaaatcgaattatcaatatgaatttattacttatggttcctgtgggttaaaaaccgcactggttgcagaaggaattgcagactgctatattcggctagggcaaacgggtgaatgggatactgctgcggcacaagttattttacaagaaatagggggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgattggcaaaaaatcttttaatttaattaatgagaactattggaaatttaaccgttttcagcatattattcttttcttttaaaatcggacttagacaaaatatgaacgtaaacgcagaaagtaattgtattgttatttttggagcttcgggagacttaactcaccgaaaattaatccccgcactttataatctatacaaaataggacgtttgacagaaaatttctctgtgttaggtgtttcccgaactgacttaagcgatgaagaatttcgtgaaaaaatgcgtaatgcgttgagaaaaacagaagatataacagaagaacatttggaaaaattttgttctcatctttattatcaggcgattgatacctcgaatgcttctgattatggaaaacttgttcctcgtttagatgagctacatgatacatatcagaccggaggcaatactctttattatatgtccacaccgccaagcctttacggtgtgattcctgaatgccttgccacacacggactaaatacggaagaatgcggttggaaacgtcttattgtagaaaaaccttttggttatgacataaaaaccgcaaaagaacttgatgtgcaaattcatcgtttttttgaagaacatcaaatttatcgtattgaccattatttgggtaaagaaactgttcaaaaccttctcgtattacgtttttccaacggcttatttgaaccgctatggaaccgcaactttattgactatgtagaaattacaggtgctgaagaaatcggtgttgaagaacgtggcggatactataatgattctggtgcaatgcgtgatatgttccaaaaccacttattacaagttttagccatggtagcaatggagccccctgctattattaatgctgattctatgcgtgacgaagtagcaaaagtgttacattgcttacacccgctcagcgaagacgatataaaaaacaatcttgttttaggtcaatacacatcttcaactatagatggtgaagtggtgaatggttatttacaagaaaaaggtgttccagcagactccaatacagaaacctacattgctttacgttgcgaaattgataactggcgttgggctggtgtgccattctatgtgcgtagcggtaaacggttaccaactcgtgttacggaaattgtcatacactttaaaacaaccccccatccagtcttcagtcaaaatgcaccggaaaataaattaattatccgaattcagcctgatgaagggatttcaatgcgtttcggcttgaaaaaaccgggtgcaggctttgaagcaaaagaagtgtcaatggatttccgctacgctgatttagcaacaccaagcctactaagtgcctatgatcgtttattattagatgccataaaaggcgatgcgacactttttgcacggacagatgcagtacatgcctgctggaaatttgtacaacccatcttgaattataaaaaagatcaagggcgtgtttacgaatatgaagccggaacctggggaccaaccgaagcggataaattaattgctaaaacggggagagtatggcgtaaacctagtggaatgatgaagaaaaaagtctaaatcaaataaatagtaattaaacgtaataacacttgccataaggaatacgaatgaatacaaaaatttttgatacggctcaacatgcagttgaacaaatcgctcaggaatttgtgcaatatagcaaacaaaatcgtgcggtgcatatttccctttcaggaggttcaacgcctaaattgttatttaaaacccttgctcaagagccgtttaaaagcgaagtgcggtgggaaaatttacatttttggtggggagatgatcgtatggttgaaccgaataatcctgaaagtaactacggtgaagtgaaaaaattactgttcgaccacattaggattccaacagagaatattcatcgtattcgtggcgaagaaaacgtagaacaagaacttgcaagattttcgcaagagctgattgcatgtgtaccggatcttactttcgactggattattttaggtatgggagcagatggacatactgcgtcactctttccttatcaaaccgattttagtgattcgaatgtagcggtcatcgcaaaacatcctgaaacggggcaaattcgtatttcaaaaaccgcaaaactaattgaacaggcaaaacgtattacttatttagtcactggtgaagccaaagcggaaattttaaaagaaattcagaccgcacttccagaaaatttaccttatccggcagccaaaattaaagcaaaaaatggcgtaacggagtggtatttggataaagccgccggaaaattattgtcatcttgatctattaattgcttaaatcagtggagcttattatgaaaaaatggttttctgtggtattaattgcgatgctttctgcttgttcgattcaaggaatttttgaaaagcaagatgtttcaacacagtttgaaattgttaaacgccgtgtgattgaaaaacacaaaacctctcaaggcataccagacggtgaattttcaggatctgacagttcatatggacgaacatttaaaacgtttgttaaacatggttatattgataaatactttgatatttaccacccaaatggaaaattacattctcatacggtgttagttgatggtatcgcacaaggttggtcttttggttatactcccgagggcattttacgaacaaaactgttatataaagatggtgcagttatcgaaattattcttttagatgaaaaaggtaatgttattcaacatattaaacaaaaagagggataaattatgtcacaaaaaggtgatatcggcgtgattggactcgccgtgatgggtcaaaatttaattttgaatatgaacgacaacggctttaaagtcgtggcgtataaccgtactacttcaaaagtggatgagtttttagcaggtgcggcgaaaggcacgaacattatcggagcctattcattggaagaacttgccggtaaattggaaaagccacgtaaagtaatgttgatggtacgtgcgggggaagtggtggatcaatttattgaggcattactaccgcacttagaacaaggcgacatcattattgatggcggtaactcaaactatcccgatacaaatcgtcgtgtaaaagccttagctgagaaaggtattcgctttattggctcgggagtttcaggcggtgaagaaggtgctcgccacggaccatctattatgccaggtggcaatgaagaagcatggcaatatgtcaaaccaattttacaagccatttcagccaaaaccgacaaaggcgaaccttgctgtgattgggtaggtaaagaaggttcaggacattttgtgaaaatggtgcataacggtatcgaatatggtgatatgcagttaatttgtgaagcctatcagttcttaaaagatggcttaggtttaagctatgatgaaatgcaacagatctttgctgagtggaagaaaactgagcttgatagctatctaattgatattacaacagatattcttggatataaagatgcggacggcgagccgttagtcgaaaaaattcttgatactgcagggcaaaaaggaacaggtaaatggacagggatcaacgccttagatttcggaattccattaactttaattacagaatcggtatttgctcgctgcgtatcctctttcaaagatcaacgtgtggcggcatctaaactcttcaacaagactatcggcaaagtggaaggcgataaaaacgtttggattgaagctgtgcgtaaagcattattggcatcaaaaatcatttcttatgctcaaggctttatgctcattcgtgaagcctctgaaaacttaggttggaatatcaattacggagcgaccgcacttttatggcgtgaaggttgtattatccgtagccgtttcttaggtaatattcgtgatgcttatgaagccaatccggacctgattttcttagggtcagatccatactttaaaggcattttagaaaatgcgttaagtgattggcgtaaagtggtagcaaaatctattgaggtgggtatcccaatgccttgtatggcaagtgcggttaccttcttagatggttatacttctgagcgtgtgccagcaaacttgttacaagcacaacgtgattactttggtgctcatacctacgaacgcactgacaaacctcgtggcgagtttttccacactaactggacaggacgaggtggcaatactgcatcaacgacttatgatgtataattcaatctcaacacaaaaaagcggtgaactgatcaccgctttttatgtttttaaattaaagaaatagtcaatttatacaagttattcattaattgcatgatttactttgtagttaaggggtaagttgtttacaatgcacaaagattttttattcatcaggattaaaaaatgaaaactgtcaaaaaaagcaaattaattatcactgcactgagtgcaatgttattactttcggcttgtgccactatagatgagcaaaccggagaacgtaaagatcccttagaaggatttaaccgtgtgatgtgggattttaactataacgttgctgatccttatgtgctaaaaccgattgctaagggttggaaagaatatgttccacaaccaatcagaaagggattgactaatgtagcgaacaatcttgatgaacctgccagcatggttaatcgtttgttgcaaggtgagtttaaaaaggcaatggtgcattttcatcgcttttggattaattcaatctttggattaggtggactcatcgactgggcaagttatagtgaacctctgcaaattgaaaataaacaccgtttcggtgatacgctaggtacttatggcatggaaacggggtcttatgtaatgttaccgctttacggaccggcaacacctcgtcaagatctcggcaatcttgttgatgtaacttatccgatgttatccttattaggtccttgggggctactcaaatcgagtatacaacgccttgattctcgtgctaatctgcttggcaaagaaacattattggaacaatcaaaagatccttatgttacattccgtgaggcttatttacagaatgtagatcatcatactcatgatggacaaataaagagaacgcaagaagaattttctaaagaagacttaaaagacatcgactaaactcaagaaggaatttattatggaaatgacctcaactcaacgcttaatcttagccaatcaatatagattaatgggtttattggatccgaccaatacacaaaaataccaacgtttagaagctattgtgaaaggcggtttcggcttagaactgaaagaattggataaagagttttccgatctttcggaagcggaatgtctcactgtattaaatactttggagatgtataacgcattacaaatttcttacaataatttgccggataagtccgctttgacaccgcatcgcttacaatttgcgggctattgtgcagtgcgggagaaaaaatatcttaattacttacgctttatcacctcagtcgaagggaaatatcaagagtttatgcgttgtgaacatggttgcgactcccaaactccaatgtgggataagtacctcaaaatgcttgacgcctggcgtgcctgtccccatgaatatcatttaagcatggcagaaattcaaaaaatcttaaatgcttaattgagtcaacgttggtaaaaaaaccgcactttataaagagtgcggttttttatgtagtttctatcagtaaatttgctacaaccggcggaatacttttggggtgaggaataagaatttgcttatgccgactcagttcacctttttccaaaataatctgactttttgccactttgaaagttttacttaaaaatttcaacaagtgagcatttgcctgtccgtcaatgggtggggcagtaatactgattttcagtgcgttatcatatagtccgataaggtgatctttgcttgctttaggttgcaaaaagatcctcaaacgtaaattatctccaattttttccacagcaggcatacatttctaccgatattgacacgatttaagccaacgcccaataatttcctaataaatcaaacattacacgattgccataaaataaaataaaggcaagtaacatgggagaaaaatcaaccatccctgttctaggtagtaggcgacgaacaggtttgagcaagggttctcccaattgatgtaataaataacttaaagctccacgattaaaccaacttaaaatcgctcctaaaaataaaatatataaaaacaattcaccaaaagttcttaaggtgtgtaataacgcaataattacgctttgtccaatgggaaaacgtgcacccactatcgcaaaaatcatatgatattttaatatgcctaatacaaagacaacaaagagcggtgcaaaattaatattttttattgtcggcaaaactttttgcagaggcaaaataattggattagtgaatttcaccaaagattgtgaaaaaggactataaaaatcaacacggcaatactgaaaccacatacgtaacataaaaagaaaacttaatacgtcaaaaatagtattcaataaaaactgaattgaatttaattgataaatcattataaccatcctttacgtttaaaataccaataaggtgcaaatgctgctaatgccatcagacccaatgccagcggatagccgaacttaaaacctaattccggcatattactaaagttcattccataatttgatgctactaacgttggcggtaaaaaaattaccgatacaacggagaagattttaataatacggttttgttcaatattgataaagcccatagcagcttgcatcaaaaagtttactttttgaaataatgactcattatgcggttgtagggactcaatatcacgcaaaatttctcgagcttgttctaactgattggtaggtaaacgtgttttacgcactaaaaaactcaatgcacgttgagtatccattaaacacaatcgtactttagaactggtatcttcttgttcagtgatagttgctaacgcctgatcaaaagcctcaccttgtttaccttctaaaataatacgactcaatttttccaaatcagcgtacacattttcaattacgtcagctaattgttcaattttagtttcaaataagtctaataacacctcataggcattacattcaactaaacgttgattgcgtgaacgcatacggtataaacgaaatgccggcaattcacgatctcttaaagtaaataatcgcccgtcacgaatggtaaaggcaacgctggctaaatcggcataatcattttcatcttcgcaataaaagaaagagtgtaaatgtaagccatcttcatcttcgaaaaaacgtgcagacgcttcaatatcctctaactctaaaaaagtggctaaattttgcccaagtccttcctgtaacaaatcacgctcttctttactcggctcaagtaaatccaaccaaaccgcattattcaactctttatcagcactttcatcaatacgaaccaaacgagcatcttcgagtgaaaaagcattaatcattttgtcatgctcctctaaagggattatgaacaacgcaatgaacaaaataaaatcaaataagacacgtataaagtgcggtgaaaattatatttgattaaaagatacctgaaaaataggtaatggaacttacctgcgtaatcccgccgataagtgctagaaagacaagacgagatttagaaaaaagataataggtatcgactatgactgtccaaagtgtatgtcctcttgttactaaatcgtgcggaatgttacgcttgaaatagctgttcgtcaaggatttttgcaagaaaaatcccactaaaagcgggatcttataaacaactttcgatttgactactttgtagggtaatcccaccaaatatcgaataattcactgatttcaatttgttgtaaaccgtttttctccaaccagtttttcaccaaagtgcgatgactttcatcacattttcccaatttttccaaacaaactaaaccttcccaatgaagataaccgctaccttcgtaagcaagtccgttttcttgaataacttcacgaataaaacgatcaacgacttcatctacttgctcaatagaggtgttttctgcaaattgccaattcactaaaaagccaagctcttggaattctgctaagtgcatttttttacgttgtctttgattacgtttaatcgccatacttttctcctattgttactattcttgtcaggctgggcaatcatagcatatttatcgcctgttcttaataaaaaaacaaaatccgagcttatattaattatttgttgtgaagtaatgaaaaaaatctttgtatcgcaggggaaataaatttgtctttataaaaaatataattaatccctctttcaaaagttaagttttttaatggaatttcaactaacagttgactattcaattcatgcgttacagccagtcttgaaataaaggaaacccctagattattgattacacaatgtttaattccttctaagctgttaaattccattatttttagttgtgtaatttgttcatggttaaaatgttgaaaaataaattttcttgtttcagaaagattaggtttcatgatgagttgttgctggctaagtgcggtgaaatcacatgctgttttttttgctaaaggatttttaggtgaagcaattaaaatgagctcgtcagataaaaatctatgagtttgataggtttgcggatcaaaataaatttgatctgacataatcaaaaaatcaatttggtgattttctaatttatgaatgagttggggagaaggtaaaatatcaatacttagcttaacgttaggtgatatttttttatattcggcaattattttcgggagcaaataaacacccacaaaatggctggcaccaatagtaatttttccgtagttgggatcatcgtattgatggagatgttctattgaagtttccaatgtagaaagtgtttgctttgcataattttggaaaatcttgccttgttcggttaaataaagtcgattattaattcgctcaaataaaactgtatttaatgactcttcaagttttttaatcttaatacttactgacggttgcgtgcaaaagagtttattcgcagtttctgttacatttaaacattcagaaagtactataaaagctttaagttgacttaaattcatatcaattccataaaaataatttatagcttgtatagaataatacaatttttttatgtttaatcaactctctataatcagattattctatagacaatatatggagtaactcaccatgaatgacacagtaattcaaaatcaagaacaccaatctgcccgaaaagaatggctgaaaaaaatcggtattccgctagctttaactatattgcttgtattgatgtttatgccaacgcctgaggggttaacaatacaagggcaaaaagccattgctattttctgtggtgcgttaactctttgggtctgtggctcaatccctatttatttaacatctttgttagtcattattttattgccattaactcagaccgttgcaaaagataaagttgttttcgctactcttggatatgatgtaatttggttaatggtatctgcttttgtgctaacttcagcaatgattaaatcaaatattgctcgacgttttgctttatggatgatcactcattttggacaaacaccacgtaaggctatgtttgttttggtattaattaattttatattagttttcttcgtaccttctaccactgccagagcttcactcatggtaccaatttgtttaattttactggaaatttatcgtgcggtaccgggtgaaagcaattttggtaaattaatgatgttacaaggtgtgcaagctgatgcaattgcaacatccggtgtaatgacaggaactgccggtaatattattgcggttggatttattaataatcaagctggcggagatattggttatcttgattggcttttggcatctttccccatagcttttgttaccatgataatttctttcttaattggttttaaactgttctcaatgaagaaagaaactcatttttttgaagctttatctcgtcttcaagcagaatataaaaaattaggttctttgactttagatgaaaagaaagctatggcaatctttttgcttacggttctactttgggcaacggaaagttatcaaaaagcatggttcggcttcaaaatcagtgtttatatgaccgctgtgatagcagcagttctctgcttaatgccaagaattggattactcacttggtccgaagccaaaattaaatgggatttaatgctgtttgctgccggtgcttatgcagcaggtaacaccttagaatcgactaaaggtgctcaatggattatggataaagtcgttcatggattaggtttagaaacaatgagccatacggctgtttatgtggtagtaatcttcgtatgtatgtatgtatagccacttgatttttaccagtaaaacggtcaaaacgacaattcttattccatctattattgccttggcacaatctttagggatgaatcctgtaaccttagctttagctgcgtcatttacactgacatatactataacgttacctccacattccaaagtaaacacaatttattttgccactggttattttagtgtgttggatcaaatgaaatacggtttggttacttgctttatcagtgcctcgatcatttgtttatcaatttttacttggttccaattacttggatataccttataaaaaaacggagaggaatcatgcgattaattttattacgtcacggcgaaacgctatggaatcaagaacatcgcctacagggacaccaaaactcgccgttatctgaaaaaggtattcagcaagcgaaagcaattaagcctttgattgagcaattctcacctaaatatgtgatcagttcagatttggggagagcactacaaacagcggaaattattggttataaaaatccaattaaagacagtgagcttagagagttggcaatgggagaatgggaaggttgtagaaaaacggaaataatagctcaacatccagctttatatcaggattggcgtaatggcgattacacaccgaatggggctgagagttggcaagcattttgtcaacgtatttcacaagcactactaaaatgggcaaataaatacgatgacgatattctagctattgttcatagcggtgtaattcgagcagcttgtgaatctttagtatcgctatctactaagcatcttttgcctgtaactcaaggaacattgacgatttttgatatcagtcctaatctacctataaaactggaggcttacaatttggggagttttattcccgccagcaatgtagcggactaaaagattatttattttaaaatctagtaaaaaataaccgcactttatagactctgtttaggatttaaagtgcggtttatttttgttaggatttattttaccctttgcattttatatttttctaagttgcttgaaagcgaatttatttagaaacagttgctttaattagtttttccgctttagctaaactattttccaccgctgaataaggggtcttagagtggctaactacttgttcggcagtatttaataacactttcacttcgccttgttccgcttcggtcaccaacacctttaatggtaattgtaatgcaagactgggatctttaaccatcaatggggtgcctacttttggtgctccgtaaatgattaccgttgcaggttgcattgttaatccagcgtctttagcggctttttgatgatcaatttttgcgaaaatggtcattcctttttttgtgagtgtatctgtaagcacagttatcgtttggtcaaaattgtacttactttcaaaagattgtggttgaagtgcatcgccatgtgccattgcgacttggcttgcgaaaagtattgaaaaaagagctattttcttcataaattacctcgttatgttatgtttttaataaaaaataaatcccaaaccccatgtcctaatttatgtccacgttgttcaaacttggttaaaggtcgaaaatccggacgtgggatatagtcatttgtggcggaagtattacgtaaacctaccgcacttgttaatacctccaacatatattccgcataattttcccagtccgttgccatatgaacaaagccgtttggtaccagtttttgttgaattttttcaacaaagtgcggttgtacaattcggcgtttatgatgttttgttttatgccaaggatcggggaaaaatagttgtaatccggctaaactattgtctgcaatacagtcttgtaagatctcggttgcatcatgacaaataacacgtagattttttacctgcttttcaactgcataagcgatgcaagcacctactcccggcgtatgaacttcaataccaagataatttttatcgggattttgtagagccatttctactaaagatttccccataccaaagccaatctccaaaatcacagggttggtgttgccataaatctgtgtgaaatcaaaagcagttgtttgatactcaagtcctaatgttgcccaattattattcatcatgttacgctgaaattcgcttaaacgtcctgtgcgtaatacaaagctacgaactttgcgtttataacgtccgtcttcagtaaattcagctatttcaacggtctttcttttttgatcggcaaacgtaatcttttgttctgtcatttcatttgactacttgttaatttggggggcaaattataaggggtttaatagaaaatataaagtgcggttaaatttatcaattaagataaagccgcactttttatttgattatgttacacttctttttattttgattacctaaattatgcaggctcaatcctctattaacaatccttttgcttatacggtacttaaatggtatcggcaattcgggcgtaaaaacttaccttggcagcaaaataaaactctatatggtgtttggttatccgaggtgatgttgcaacaaactcaagtagcgacagttattccttactttgaacgttttattaaagtttttccaaatattaccgcacttgccaatgcacctttagatgaagtgctacacttatggacaggactgggttattatgcaagagctcgcaatttgcatagggctgcacaaaccataagagatcagtatcaaggtgaatttccaacggattttcagcacgtgtgggctttacccggtattggacgtagtacagctggggcggttttatcttcagtacttaatcagccttatcctattttggacggtaatgtaaagcgagtgctgactcgttattttcaggtgcaaggttggactggtgataaaaaagtagaggagaagctttggcaattgagtgcggaggttacccctacagagcaggtcgcagattttaatcaagctatgatggacttaggtgcgatggtttgtactcgtacaaaacctaagtgcttgttgtgtccattagccataaagtgcggtgctaatttaaacaataattgggtagattttccgtctaaaaagccgaagaaatcgttacctgagagaaaaagttattttctgattttggagaatcaaggtaaggttggtttagaacaacgccctatttcaggactttggggcggattatattgttttccgcagtttgataccctgactgaattattggcttatctttctcagcaaggtattcaacaatatcaacaatggacggcatttcgtcatacattcagccattttcatttagatatttatccaatttatgcacaaatacaaactgaggaagtggaatttgatcgcacagattggaaaaaaattgcagaaaataacgtagaatattgttctcctatatcaagtgcggtcaaatattggtatgatcctaccaatccaagccaaattggtttggctgtgccggttaaaaatttattgatcgaatttcaaaaaaggaaataattatggcaagaaatgtgttttgcacttacttaaatcaagaggctgaaggattggattttcagctatatcccggcgagttaggtaaacggatttttgacaatatcagtaaacaggcatgggcggaatggatgaaaaaacaaaccatgttagttaatgagaaaaaattaaatatgatgaattccgaacatcgccagttattagaacaagaaatgacaaattttctttttgaagggaaagatgttcatattgagggctatgtgcctccgacagaaaaataatttaacatgaaaaaatatattgtatttgcgattattccttttctttttgcttgtagtagttctaggctaaatgatgactatgatgaagcttttgcaaaagatactcaaggacttgatattttaaccggacaattttctcataatatcgatcaaatttggggagtaaatgaactcctcgtggcaagcagaaaagactatgtaaaatacacagataatttttacactcgcagtcatatcagctttgatgaaggttctattatgattgaaacgttgggtgacaaaagtcgtttatatcattcgattattcatactttattaatgggtgcggatgcaaaaggaatcgatttatttacctctggcgatgtgcccatcagttctcgtccattcctcgtcggattagttgttgatcataaaggtaaacaagttaaaaatattgcgacggcaagtaattttgcaaattatcttttacaaaataagttgcaaacacgttacctcactaatgggaatcctgtacagtatgttattattccaatggttgcaaaccatgttgcagtgcgtgcccaacgctatttacctctaattcgaaaagccgccggacgttatgggatagatgaaagtttaattcttggtattatgcaaacggaatcaagtttcaatccttatgcaattagttatgctaacgcaataggtttaatgcaagttgtacctcatactgcagggcgagatgtattccgtttaaaagggttaaacgggcaaccgtcaaaaaaatatctctttaatcccgctaaaaatattgatacaggtgttgcctatttgactttattacgggataaatatttagatggtataacaaatccaacttcaaaacgttttgcaatgatttccgcttacaatagcggtgccggagcagtactacgagtgtttcataatgatcgagatatagcaattaacaaaattaatcgcttatatccggagcaagtatatcgtattcttactactatgcacccctctgagcaagcaagaaattatttactcaaagtagataaagcacaaaaaagttatagagtgattaagaatagcaaatctgatttgccttaataaaccataacaaaagaataattaagttacgcatgcttaaaagctaagatatacttaactgacttttcattaaacttattcatggagaactgttatgactgccctttttaccactgctcaaaactggctcgctcaagaccctgatgcggaaactcgtgcagaattacaaacattactcaaccaagccaaagcaggcgatatgaatgcacagaaagagttacataaccgttttaacggtcggttgcaattcggtaccgctggtttacgcggtcgcttacaagctggttctatgggtatgaaccgtgtactggtagctcaagcagcgggcggtttggcggaatacctaaaaggctatgatagtgaaccctctatcgtattaggttatgacggtcgtaaaaactctgatgtgttcgtacaagataccgctgaaattatggctggtgcgggcatcaaaaccttccttttgccacgaaaattgccaacacctgtactggcttacgctatcaaatacctcaacactacggcgggcgtgatggtcactgcaagccacaaccctcctgaagataacggctataaagtttatttaggtaaagcgaacggcgggggacaaatcgtctccccagccgatgttgacatcgctaaactgattgacaaagtggctaacggcgatattcgtgacttaccacgtagccaacactacacagtgttagacgatgagatcgtagaggcatatatcgcaaaaactgcctctattgccaaagagccacaagcaaatattaactacgtttacaccgcaatgcacggagtaggctatgaagtgttgagtaaaaccttagcgaaagcaggcttaccacaaccatatttggtcgaagagcaaattcaacctgatggatcattcccaacggtcaatttcccaaatccagaagagaaaggtgcgttagatttagcaattaaactggcaaaagcaaaaaatgccgagttcatcattgccaacgaccctgacgcagaccgtcttgcagttgcggtacctgattcggaaggcaactggaaacctttgcacggtaacgtgattggttgtttcttaggttggtatctagcaaaacaataccacgcacagggcaaacagggcaaattagcttgctcactggtttctagtcctgctctggcggaaattgcgaaaaaatacggtttccaatccgaagaaactttaactggtttcaaatatatcggcaaagtgaacgacttattgttcggctttgaagaagcattgggctacttagtcgatccaaacaaagtacgtgataaagacgggatttcagcagctattgccttcttagatttagtccgtagcctgaaaaaagagggtaaaacactaacagattacgctaatgactttactgcggaattcggtgcatatgtaagcggacaaatctctattcgtgtgaacgaattatcagatatcggcaaaatgatgaccgcacttcgtaaagaaccactaacagaattaggcggtttcgttacacaatttattgatcacagtaaaactgatcgtgctagcgatattctcgtgtttgtgcttgaaaatggtagtcgccttattgttcgtccatccggcaccgagccgaaagtgaagttctacttagatgtgtgcggtacagatccgaaaaatgcagacgaagtattagcggagtttgatgagaacgtacgccaaatcctccgacaagagaagtacggaaaacaggattgctaatttagcataaacacaaaagcacgttttatacctacctgttattttatcgactccatataaaaatcaccgcacttttatctcaataacgaaacaaaagtgcggtagttttacagcaaaatcagataaaattatccctgtgaagaaatacgtttcatgtctgtcatataaccacgcaattcctgaccgattaattcaatcggatgctgacgaattgcatcatttacatcacgtaacaaaatattatcgatttctgttgctggtgttgactcacctaaatcaccacgttttaacgttggaataatttctttagctaaaattggagccgctacgttagcaaataaataattaccatactcagcagtatcagagatgactacattcatttcatataaacgcttacgagcaattgtattggcaattaatggtaactcgtgtagtgattcataataggcagactcttcataaattcccgtttctaccattgtatcaaaagccaattcaacgccagctttaaccattgctaccattaatacgccatgatcgaaatattcttgttcggaaattttaatattttctccttttggtgcattttcaaatgctgttttaccggtttgttcacgccatttcaataaattagcatcaccgtttgcccagtcttccatcatgacacgggaaaattcaccgctaataatatcatccatatgttttttaaatagaaaatccaatttttctttaatttgctcggaaagggaaaatgcacgtaacttagcactattggataaccgatccatcattaaggtaataccgccttgttttaaggcttcagtaattgtttcccaaccatattgaattaatttacccgcatatgccggatctttaccatcagcgattaacttgtcataacatactaaagaaccagcctgtaacataccgcataaaattgtttgctctcccattaaatcggattttacttccgcaacaaaagaagattccaaaacaccagcacgatgtccaccagtcgccgcagcccatgctttagcaatggctaacccttcacctttcggatcgttttcaggatgaacagcaattaacgtcggcacaccgaatccacgtttaaattcttcccgcacttccgtcccaggacacttaggagcgaccattaccacagtgatgtcctgacgaattttttctcccacttcaacaatatttaaaccatgcgaatatcccaaagctgctccttgtttaattaacggcataacatcagcaacgactttagagtgttgtttatctggtgttaaattaatcaccaaatccgccgtaggaattaattgctgataagttcctacaacaaatccgttttcacttgctcgctgaaaagaagcacgtttttcctcaatagcttccggacgaagggcataagcaatatccaaaccggaatctcgcatatttaaaccttgatttaatccttgagcaccacatccgataatgacaatttttttaccttttaagaaattaacgtcatcggcaaattcctcacgatccataaagcgacaacgacctaactggtcaagttgttgacgcaaatttaatgtattgaaataattacccatttccaatctccttatgtaatattccgctggttataaccaaattaaaatttacggtaaaagcattatacataaatttgctattgcgtaaattgactttattgaaaacttttatttcgttttctcaaatagatctgtttttgtttgtaatttatttttttaatttaaagtagtatgaaaaaacagtataattaaggggttagttaattttttcttaacttcttaattttaagaataatttcttttttgggggaataatgagaatatttaaatcaataaaacaattctttgttaagccatctgcaaaaatagggttaggtatccttttggtcggcggtgcctttgtaggaattgtaggttggattatctttaatgccgttcttgaccataccagtcaagaagaattttgtataagctgccattctatgcaatatccattagaagaactcaaacaaaccgctcattggtccaatgataaaggggtttccgcaagttgccctgattgtcatttacctcacaatacggtggataaatatattcgtaagattcaagcaacaaaggaaatttttgccgaattaagcggtaaaatttcttcgaaaacagactttgaaaaacaccgtctagaaatggcagaaagggaatgggcgagaatgtccgctaacggttcggcggaatgtaaagcttgtcacagctatgatcgaatggattttgataaaatgtcggagattgcacgcaatgccatgatacctgcagctgaaaaagatcaaagctgtattgattgccataaaggaattgcacatcatcttcctgaaatgtcacattcatcatcaaaaggcaatggtttaccatcaagctctttacaagcaaataaaatctattatacggaaaataatgtcgctctttttgcagatgaaacaatggggcaagaaatcgggcagttagaaactggtgtaccagtacattttgtgaaaacaacaccaaacgcggatttagttgaactggaaatgtggcgaaaagacaaaggctttggacgaatttggtataaccaattcggaaaaaatattaccgatgccatactaactaaagaatttatgtcggcggagcctaaatatgatgtattggaaagtgttgaagatcctattaccggtctaacttggcaaaaagtaaaactttctgtatggattggtaaaaatcaacttattgaaaatattgataatttatgggctgaagcggaaaaaatttataaaacgcaatgtagtacttgtcatagacaacctgatgtaaaacattttgattcaaatacttggattggactgtttaatggtatggtcggttttactaatattgataaaccaacaggaaaacgtgttttacgctatttgcagatgcattcatctgattttcaaccgcacgataataatcattaatgaggaataaaactatgcaacaatcacgtcgtcaatttttgaaaaatatgtctgttatggctgcgacttttgcaatgcctaacttcctcgttgctaaaagtgcggtggaaaataaacaagatttatcacaatggaaaattaccggctcccattggggtgcaattcgtgccaaagtcgttaatggtcgagtaagtgaaattaaaccttttgagtatgatgaatacccaaccgagatgataaaaggaatcaaagggttaatttatagcgaatctcgcattcgctatccaatgatacgattagattggcttaaaaatagacacaacagcaatacagagcaacgaggagataatcgctttgtacgtgtaacgtgggacgaagcccttgacttattctatgaagagttagaacgaattcaacaaaattacggaccttgggctttgcatacgggtaacgtaggttggcgttcaacaggacaattccacagctgtggtaaccatatgatccgagcaatcggcatgcacggacacagtgtcagtactgccggagattactctaccggtgccggacaaattatcatgccttatgtgttaggctcaacagaggtttattctcaaggaacatcatgggagattttacttaaagagagtcaaaacatcattttttgggcaagcgatccggtaaaaaatttacaggtcggttggaactgtgaaacccatgaagcctataaatatttagcccaactcaaacaaaaagtagcagataattcaattaatgtaatttgtgttgatcctgtgaaaagcaagacgcaaaattatctgggatgtaaacatcaatatatcaatccgcaaactgacgtgccttttatgctcgccatagcatatgtgctttatacggaaaatctttatgataagcagttcctcaaaatgtacactgtaggatttgaaaaattcgtaccttatttaacaggtgagtcagaagataaaacagcaaaaacccctgaatgggcagaaaaaatatgtggtatttctgcaaataaaattcgtgaatttgcacatttactggcaggcaaacgaactcaattgatttttggttgggccattcagcgtcaacaacacggtgagcaaccttactggatgggtgccgtcttagccgcaatgctcggacaaatcggtttaccaggtgggggaatcaattatgcctatcattatagttctatcggtatacctgaatcaggagccgccatgccgggctctttccctttgaacttggatgaaggacaaaaaccgaaatacgaaagcacggattataacggttatagtgcgattattcctgtagctagattatctgattccttattaaatccgggtaaaacaatcgattttaatggacaaaaagtggtttatgctccatataaaatggcaatcttcagtggttgtaaccaatggcatcgtcattctgaacgcaataaaatgaagcaagcttttcaaaaactggaaactatagtatcaattaattacagttggacagccacttgtcgtttttcagatattgtattaccagcctgtacgccttttgaacgtaatgatattgatgtttacggttcatatagtaaccgtggagtcattgctatgcaaaaattagtcgatccgctttacgattctcgttcagattttgaaattttcaaagaattatgtcgcagatttggtaaagagaaagaatattgtcgtaacatggacgaaatggaatgggtagaaaaactttacgaagactgtcgaaaagaaaatgaaggtaaatttgctatgccggcctttgaaaaattctggaaaacaggatttgtactttttccggaaggtaagccttgggtaagacatgcagacttccgagaagatcctgaacttcatgcaattggtacaccatcaggttttattgaaatttatagcaacaaaatcgcttcctacggttatgaagattgtaaaggtcatccaatgtggtttgaaaaaacggaacgttctcatggcggaccaaaatcagataaatttaaattctggttgcaatcagttcaccctgatcaacgtttacattcacaactttgtgaatcaaaagaattacgtgaaacttatactattcagggtagagaacctttatttatcaatccaaatgatgcaaaagaactaggcattgctcatggagatcttgtgcgagtttataatgatcgaggtcaagctattgtaggtgcacacctttcagaggactatccaagcggtgtagtgcggttacaagaaggtgcatggtattcaccgttagatgaaaaaatcggctctattgatacttatggcgatccgaatactatgactcttgacataggttcttctagcttagctcaagctgtttctgccaatacatgccttgttaatattgaaaaatataaaggcattgctcctgaacctaatggtttcaaaggtccaatagaaattgcattatgataacgttgaataccgaagaaaaaatctttatttattcatggcttaaaaatatattaagccatgaattaactgaacagcagctacaacaatatcaacaaggggtttttactcccttgtttgattttttgtcagaacaagatttggcgaagcaaataaatactgttcgaaactcactcatgcaattatctaatttgcctttagctcatttagaattagctgcggattttgcccaacttttcttgttgaatggagaaaatagtgctttgccttacgcctccgcttacttatcggaaaaagaactaaatcaacatattgcatttattgaccatttactatttaaataccagctaaagtttgatcacaatctacgtgaacccagcgatcatctcgctgtttatttagaattactgataacccttgaaaagagcggtcaaaaagagaaaagttttaactttattcaacattatttattagcttggcttattccttttaataaaaaagtacaaaaaattaaaacagaaacctcgttctaccaagccataacagaaatattaatcacgctgttaaataaaaatgtaaaactctcatagcatttaacaaaatcatcaacaaattagtgagtgatttttatgctggatataaaaaagctaatcttaaaagattagcttttactttatttaatttgcctttcaatcacaccgccaccgagacatacctcaccttgataaaaaacagctgattgtcccggcgtaacagcaatttgtggctcatcaaaccgcacttcaatacaatcatcatttataggaataacttcacaagcaacatctttttgacgataacgtgttttgactgtacaacgtaaattttgacgaattggcaagcgatcaatccaatatagctgagtagccattaaaccttgtgataacagggcagaattatcatttccttgtgcaactactagtacattgttaattaaatctttgtctaccacataaaaaggatcttcacttaacccttttactccaccaatacctaatcctttacgttgacctaaggtgtaatacattaagccatcatgtttgccgatgactttaccgtcaaccatgcgaatttcacccggttgagcaggtaaaaatctttccagaaaatccttaaatttacgttctccaataaaacaaattcctgtagaatccttcttttccgccgtaatcaaaccgagatctcctgctatagccctaacaatcggtttttcaatttcacctacgggaaatagactttgtgccacttgatctttgctcaaggtataaaggaaataactttgatctttattactatccagaccacgtaataattttgtttgtccatttacatcggatcgacgaacataatgtcctgttgcaatgtaatcagcacctaaatcttctaccgcatattccaagaaagccttaaatttaatttctttattgcataaaatatcaggatttggtgttcttccggctttatattcagctaaaaaatgctcaaatacattatcccaatactcagcagcaaaattaattttatgtagctttattcctaatttatcacacacagcctgtgcatcagctaaatcgttagcggcagtacaataatccgtatcatcatcttcttcccaattcttcataaacaatccttcaacttgataaccttgctgttgaagaataaaagcggacacagaggaatcaacaccaccggacataccgcaaatcactttctttttactatttttagcaatttcaagtgcggtaagttttggtagttttttttcataaacaatggatttcatatttttatttatttttaataatcaagttaattttttattgaaggtaatttttagataaaaacataaatacgctttcatattgcgaggtgtttacatcaaacatctgtaaaaatctgtcagccgcttttctatctgcaatttctttttgaacaaatcgttcaaaatctttcttcaaactgtgggaaaaagattttctcatattaataaatttgactaataatgtatgagaataataaccttgctgaaaaatatcctttaaaatattgtcctgctcgatcattaatttgttaatattatcaaattgttcttcaataattttcttatcttctgtggaactaattttctctgaaattttccatttctcagccaaaatttcatctaacttaataaaattatactttattttttcagcatccttcactggtgcaataagtgtataacttgaaccatcaatctttatttcctttgggttagtcttcttttctacagcgaaagcaatagaaaaaatttgagaaattacaagtatcaaaaaaagtaattttttcacaaaagcttctccagataaaaaatatcaagaatattaacgttatttcaactcataaaactgcggttgttttttcgcaaatttttcttcatattcagtttttgcatcttcatcaccagcagcaagtttagcctgcaagttatcacatggagtatcacaatcacagacttttttcatccctaaagcagatataccaccacaacttccagcaatggacttacgctttatgatataaccaagagacatacctaaaataactaaaacaaaaatagcaaaagtgactaaaaataatttcatagaaactccttattttttctgagttgataatatttcagcaaatttagaggacattttattttcaaacccttgtggagttttgaccgttaaataaataggtaaatcattttgctcagcaatttccagtgctttttccgcacctaaaacaaataaacctgtggataagccgtctgcagtcatagcacttttagataagactgtaattgaggctaaattatgctgaacgggctggcaagttgtaggatctatttcatgggaaaaacgttttccatcttgctcaaaataattgcgataatccccggaagttgccatagccaaatcttgtaaaccgacaacttgtgatacagatcgagttccatcaaaggttggcttttcaatagctatttgccaagctttattttcagcattatgaccatttgctcgaatctcaccgccaatttccactaagtagtcagtaataccttgctcagcaatataatcagcaactttatcgacaccaaaacctttagcaatagaagataaatcaatataaatctgcggcacagatttggtcaaaaagaatttattgtctttttgtgttagtctaactttctcaatacctacccaggcttttcgttcagctatttgctccggtgtgggtgctttttctacctgtttttccggtccaaacccccataagttcacaataggaccaactgttacatctagagcaccttgagtaatttgatttaactttattgcttcagcaactacaaaagccaaatctgcggaaatttcaataggattatttatctccttgtttttgttgaacacacttaactctgaattaggaatataagtggacattttagcatttacatcttgtaagataccttcaatgccttcgtgcattttttgtactcttaacttagtcttgccattatcaatatatttgatatggtaagttgtacccatggttctaccatttaatgacactaactcagcttctttttggcaagcactaagtaaaaataccaacgcaaatatatttattaaatttaataataatttcttagtcataaagtgcggtttatcctatttataagtttttactaaaggttcatcagcctttttaatatcaatatgacaatagccattaggattttttaataaataatcctgatggtattcttccgctggatcaaatcgttgtaaaggcaacacctcaacaacaattggtttactgtattttttctgttcttgtgtaagagcggttaaaataatttctctatcctgtggatcggtatagtaaatacctgttctatattgtgttcctttatcattaccttgttgatttaaactagtaggatcaattactcggaaataatattgcaaaatatcctctaaacttaatttattttgctcatagatcactttaaccgtttccgcatgaccagtattattgtataacacatcttggtaacttggattttcagttttaccatttgcataacctgaaatagcatccaacacaccatcaatacgatgaaaatagccctctactccccaaaaacaacctcccgcaagataaatagctttgttgctcatacgtaattccctttatgcaagtataattagtttaaataaaatacaaagcggtcagcttcaaaaatttatgaaatctgaccgcactttattgatcatttaagatcagccaccaaaatcatctaataagatattttcatcttcaacaccaagatcttttaacatcttaattaccgcagcattcatcaccggaggtccacacatatagtattcacaatcttccggtgcttcatgatttttcaagtagttttcataaagaacattatgaataaagcctgtgtaaccatcccaatcatcttcaggaagtggatcagaaagagccacatgccatacaaagttatcgttttcggcttgaagcatatcaaaatcttccacatagaacatttcacgtttagaacgagcaccataccaaaatgacattttacgttttgattttaaacgttttaattgatcaaaaatatgtgatctcattggtgccatacccgcacccccaccgataaagaccatctcattatcagtttctttagcaaaaaattcaccaaatggacctgaaatagtaactttatctccttctttcaaagaccaaatgtaagaagacatttgacctggcggtacatcaggattacgtggtggaggtgttgcaatacgaacatttagcattatgatacctttctcttctggatatgaagccatagagtaagcacgaataatatgctcgtccacttttgaagtataacgccataaatcaaatttatcccaatcttcgtggtattcttttggaatatcaaaatctttatagtgaacagtgtgtggttctgcttcaatttggatgtaaccaccagcacggaatggtacttcttcaccttcaggtatttgaagtttaagctctttgataaaagttgccttattgtcattagaaataacagtacattcccattttttcacaccaaaaacttcttctggtaactcaatcttcatactgttcttcacatttacttgacaagaaagacgataaccttctttagcttcacgctttgaaatatgtgaaagttctgtcggcagaatatctcctccaccttcagtaactttcacgatacattgaccacaagaaccaccgcccccacaagcagaggatacaaagatacctttatttgccaatgcacctaataatttaccacctgctggtaagttaatagctttaccaggatcatcattaatttcaatagtaatgtcccctgaatttaccaatttagatttagcaaacaaaataagtacagctaaagctaaaacgataacagtaaacattgcaataccaagagtaatttccatttaagtatcccctattacaactgaacaccggaaaatgacataaacccaagagccattaagccaacagtgatgaaagtaatacctaacccacgaagacctgccggaacatcagcatatttcattttctctgtaataccggcaagagcaactatagctaacatccaaccggtccctgcaccaataccataaacaacagactcggcaaagttatagtcacgctgaaccataaaagataccccaccaaagattgcacagtttaccgtaattaaaggaaggaaaatccctaatgcgttataaagtgcggggaaatatttgtctaaaatcatttcaagaatttgaactaatgcagcaattaccccaatgaaagtgatgaaatttaagaaacttaaatcaacaccatcaattaaagctccatctttaagaatgagagaataaaccaattgatttacaggcacagaaatacctaatacaacagtcaccgcaacacctaaaccaaaagctgttgatactttctttgaaactgcaaggaatgtacacataccaaggaagaaagaaagagccatgttttcgataaatacggattttacgaaaaggctaatataatgttccataaattatttctccacctgttccggtttccatgttctcaggccccaaataatgaaaccgataataaagaatgcacttggtgctaataaaaacaaaccgttggtttgataccacccaccatcttggatagtttggaaaatagtcataccaaataatttacctgaaccaattaattctcgaataaaagcgacagtaactaaaattgctccatagcctaaaccattaccaataccgtcaacaaaactttctattggtgcagatttcattgcaaaagcctccgcacgtcccatcacgatacagtttgtgataatcaaccccacaaaaactgaaagttgttttgataacccataagcatacgcacgtaaaatttgatcaaccaaaattactaacgaagcaataattgccatttggacaattatacgaatactgttcggaatataattacggattaaagaaataaaaaagcttgaaaaagctgtaacaagacttaccgcaattgccataacaactgctgtttcaagtttggttgttaccgccaacgcagaacaaatacctaaaatttgtaatgcaatcggattattatcagtaatcggtgataataataactttttaatatttgcatttgccattagttagcccccttttttagttttgctaaatatggaccaaagccattagcaccaaaccaataatcaaacgtaccttgaactcctttagaagttaatgttgcaccggaaagactatcaattccatgttgtgcatcagacgatgcacctttacctacacgaatagccggttgattttcttcatcaagcagtaatttaccaacaaatttagcttgccattttggattttcaatttcgcctcccaacccaggtgtttcaccatggtcatagaatgtaatacctttaattgtattaccatccggttgaattgaaacaaaaccatacattaccgaccacaaacccgtaccatacacaggtaaaacaatttggtttatctgattgttctcatctttaacaagataaacttccgctaatttagcacgttgacgtaaaccagctttatcatcttgaggggcaatagaaacattttgagcggaatctttcgctgcagattttgcatcaaaaccggtaggacattttacataatcaccagaatttaattccacacaacgagcttcaatattcttagtaaaaatatctttaatttgaccggcttttgtatctttttgcaataatcctgcaacacttaaaatatttttttgcttatcaagttgtttttgttcttcttgtgttggttttaacaataccgcagaaccagcaacaataacagaacaagctaaactcaacagaacaacaatcgaaattgttcctccaacactatctttattaaatttagccattgcgagatctccgacgtttaatatttgcttgaacaacaaggtagtcaaataacggtgcgaataaattagcaaataaaatagccagcatcataccttcaggatatgctggatttgccacacggataattacagccatcacaccaattaatgcaccatataaccatttacctttattagtaaatgcggctgaaacaggatctgttgccataaaaaacatacctaatgcaaaaccgcctaatacaaaatgccaataccattgcattgcaaataatggattagtttcagatccaataatattgaataaagttgaagttgcaatcataccaatcatcacaccagcaatgatccgccaagaagcaattcgagcaaaaacgataattgcagctccaattaataaagcaaaagtagaaacctcacctatagaacctggaatattacctaaaaaagcatccatccaagtaataggctcgcctgttgcaacatgttttaatgcaacttgtccacctgcagcccattgagaaagtgcggtcgcaccagagaagctatccgcagctgtccaaaccaagtctccagaaatttgagccgggtaagcaaaaaataaaaacgctcgacctgctaatgctggattcatgaaattcttaccaacaccgccaaacacttcttttgcaacgacaacaccaaaggttgttgccaatgccgcttgccataatggtaatgtagggggaacaatcaatgctaataaaatagatgtaacaaagaaaccttcattaatttcatgtttacgcaccattgcaaataaaacttcccaaaatccaccgaccaaaaagacagttatgtaaattggtaaaaagaaaattgcacctaatgccattttagctaaaacaccagcatcaatagacactaaaccaagcatgtttgctaatgcaaagtgccaatcattagctacattttgagctaagtttgcagaaaaatcaccaacacttaatgcaagaattgattgtgcaccaacattgtacattccgtaaaacattgcagggaataatgcaagccaaacaagcaccatcatacgttttgagtccaatgcatcacgaacatgtgaagatttacctgttactgtacccggcgtatataaaaatgtcgctgtcgcttcgaacaatgcataccatttttcatatttaccacccggcaaaaaagcaggttccattttctctaaaagatgttttaaacccatttttaaccttccttctcgatcttatctaatgctgcacgtaacatcggaccatattcatttttacccggacaaacgaaagtacataaagccaaatcttcttcatccaattcaagacagcctaaagcctgtgcactatccgtatcacctgatgctaaatcacgtaataataatgtaggtataatatctagaggaacaacacgctcatatgcaccaatcggtaccatagcacgatgaccaccatttactgcggaagtaaaattaaataatttactgctgaaatgtcctagtactgttcgagtaatggaaaatttgttttttcctggcataatccagcctaaaaattctttctcacgaccttcagcaataacagatacttgcaaagcataacgtcccaaatagttatatggaccgattgctgtattaccacttaacactgaaccagaaataactcgattttcacccgcacttaattcattttccgttaaatgtgaaagatttgcacctaactgcgtacgaattaaacgaggatttttaacttgtggtccagctaaagaaaccactcggtcagtataaatttcgcctgtagtaaataatttaccaatagctataacatcttgataattcaaataccaaactgatttagttgcactaacaggatcaataaaatgtatatgtgtaccacttaatcctgctggatgtggtccactaaaatcatgaacagctaagttaggtaaatcaatcgttgggatattgctatcaccagctttacacaaatgtaatttgccttcatgtaaacgacttaaaacggttaatccatcagtaaaatcctgccaatgttcttttaaaacaatttcaggatttgctgataatggatttgtatccattgcattaacaaaaatagaagaaggtactgcatcactcgcaggtactttactgaaaggacgcgtacgaagtgcggtccataaaccagaagattgtaaattttgacgaacttggtctgaagtcaattttttcaattcatcttcattatattgagtaaaggtaatttgttcattaccttccactttaattaccacagattgtaaaactcgcttagcaccacgattgatcgcagttacagtaccacttgcaggtgcagtaaatacaataccaggattttttttgtcttcaaaaagtacctgaccttttttcactacatcaccttcacgcaccttcatcgaaggtcgcatacccacatactcttcgccaagcaaagcaacttctttaacagtattaccgttatggattacttgttctggttttcctgcaataggaatatccaagccttttttaattgtaatcatattgtttgcactacttttcgttagattaaaatatagttgtaacaaaaaagtaacaaccgcgtcttgagtaatgatttcagccgacgaactactaaaaatcaatttatccgcttcaatcacataaaaataaaactcaaattctgttttttactgtacctagcttaatgatagaaacaataaattaaaaatttactaaaaatcaacgagtcattttaactaaataatgactccgattccactttagacacctttttttatgtttttttatgaaatttttgatctatttttgtaaaaaaatcaattctaaaccaaaatattgctaaagagttactgaccaatacctgaacaattaggtgactttggaaaaactttgcctaatttttcccattcttcaggactatataaatgtaaagctaaagcatgaataccttgttgtaactcactactaaacaatgagtaaactaaacgatgacgagcgacttttgtcaaggatgaaaacctattgctcacaacaactaatttaaaatgagagttagcacctcgacctgagctgtgcatataactttcattttctatctgtaaaaagtgcggtgaaaattcttgtaatagctttttttctaggactttttgtatcgacataagtttatccttatttttactatttgatatttgatgtataacactatattttcattaataaaaaacagattttatttttatcttacatcaaaaatagaattttttattactcaactctgtttttttattgcatactctttcattacatcaacaaaaaaccgccttttggcggttttttatttataagattaacgttttctttgtgttaaacgatctgttaattcataagcacgtaattttgccaattctcttgaaagtttagataccaacatttcataattagcatctttggcaccagaaacaatattttgttcagccttacgtttcgcctccaaaatacgttctctatcaagttccttaccacgaatagcaacatcagctaaaacagttacaactgttggttgaacctccaaaaaacctcctgaaatgtaaataacttcctcagtatcatcttcaagagtaatttttataatacccggcttgatagcggtaagtaagggtaaatgtccggctaaaatacccaactcaccttcagaacctgtagcttgaatgcctttaacttcaccattaaaaatatgttgttctgcacttactacgattaatttaaatgtcgccatctttttctccttcaagtttgctgttaatcagtcttgaagtaactacatttttttggctttttctagcacttcttcgattgagccaaccatatagaacgcttgttctggtatatgatcgtattcaccatctaaaatacctttgaaaccacgaatagtatcttttagtgatacatatttaccaggagaaccagtaaatacttctgcaacgaagaacggttgtgacaagaaacgttctattttacgtgctcgtgctaccactagtttatcatcttcggaaagctcatccataccgaggatagcaataatatcctttaattctttatagcgttgcaaaataccctgcacacctcgagctacatcataatgttcctgtcctactaccaatggatctaattgacgtgaagtagaatccaaaggatcaacagctggataaatacccaaagaagctatattacgacttaacaccactgttgaatccaaatgagcaaaggttgttgccggagaagggtctgtcaagtcatccgccggaacataaacagcctgaacggaagtaatagaacccgtttttgttgaagtaatacgctcttgtaaaacacccatttcttctgctaatgtcggttgataacctaccgcagaaggcatacgacctaaaagagcggatacttctgtgcctgccaaggtataacgatagatattatctacgaaaaataatacatcacgaccttcatcacggaatttttccgccatagtcaatcctgttaaagcaacacgtaaacggttacccggcggttcattcatttgaccataaaccaacgatactttatctaatacattagattctgtcatttcatggtagaaatcattaccctctcgagtacgctcacctacacctgcaaatactgaataacctgaatgttcgattgcaatattacggattaattccatcatatttacagttttacctacaccggcaccaccaaataaaccaactttaccacctttagcaaaaggacaaattaggtcaataactttgatacctgtttctaaaagttctgtactatttgattgttcttcatagcttggtgcagcacgatgtatagcccaatattcttccgcaccaatttctcctttttcatcaataggctctcccagaacgttcataatacgtcctagtgtttttgttcccacaggaacagaaattggatttcctgtattttctacttttaaaccacgttttagaccatcagatgaacccaatgcgatacaacgtactacaccgccacccaattgttgttgaacttcaagagttaatcctgattcaacttttaatgcatcataaacttttggtactgaattttgtgggaattcaacatcaattaccgcaccgataatctgtataatttttcctgctgacattaccttatctccattaaattgctgctgcacccgcaacaatttcattcaattcatttgtaatacttgcttgacgagctttgttatacaccaactgcaagtcattaattaaattacctgcattatctgttgctgctttcattgctaccattctagccgcctgctcagaagccaaattttcaacaaccgcttgataaacttgagattccaaataacggactaataaactatccaacaaagtttgaggatttggttcgtaaatgtattcccaattatcactatttttgcctaagctatcattatctaattccggtaatggaacgagtttttccattattggtttttgcgacatcgtattgatgaacttattataagtaacatagattgcatcaattttaccttctttataagcctcaaacatacgatttgctataccaattaattcttcagctacaggggtatctcccatacctgaatgctgagctttaatatttaaaccaagagattggaaaaaacctataccttttgctccaattaaacctaatgaaacatcaacattttgttctttccagttttttatttcagaaagtgcggtcttaaataaattaacatttaaaccgccacataaacctctatcggttgaaataattaagatgccaacgtttttaacttctcgttcaatcaaaaatggatgttgataatcaatattggcttttgatatatggctaattacaccttgtattgctttagaatacggacgtgaagacgacatacgatcttgcgttttacgcattttcgatgctgcaaccatttccattgctttagtaattttttgcgtactttgcacactggatattttggttcttatctcttttgcaccagccattttatttctccgttaattaactattaccatgtaacatttgctttaaattgatctaaaacggtcttcaatgtatttttaatttcatcatcataattaccagttttagtcaactcagccataaattcagcatagttgtagtttgcatattctaaaagtgcggtttcaaaagtacctatacgatttaattcaacgtcatctaaataaccaaattcaacagcaaataataccagagcctgttcagcaacacttaacggtgaatactgtttctgtttcaataattcagttactttttgtccatgtgataattgtttacgtgtagcttcatcgagatctgatgcaaattgagcaaaggcagctaattcacgatattgagcaagtgcggtacgaataccaccagccaattttttaactactttggtttgtgccgcaccacctacacgagaaaccgaaatacccggattcactgcgggacgaatacccgaattaaataaattggattccaagaaaatctgaccatccgtaattgaaattacattagttgggacaaacgctgaaacatctcctgcttgagtttcaataataggaagagcggttaaagaacctgtttttcctttcacttcaccttttgtgaatttttctacatattcttcactcacacgagaagctcgttcaagtaaacgagaatgaagatagaacacatctcccggaaaagcttcccgacccggtggacgacgtaaaagtaatgaaatttgacggtaagcaactgcttgtttagataaatcatcgtaaacaattaacgcatcttcaccacgatcacggaaatattcacccattgcacaacctgaatatggagcaaggtattgtaaagctgctgattcagatgcagaagctacaacaacaatagtattttgtaatgctccatgttcttctaatttacgtactacgttagcaattgttgatgctttttgaccaatagcgacatatatacattttatacctgaatcacgctgattaatgatggcatcaatagccaatgctgttttacctgtttgacggtcaccgataattaattcacgttgaccacgaccaataggaaccattgagtcaacagccttataaccagtttgtacaggttgatcaacagatttacgttcaattacacccggtgcgataacttctaccggtgaaaaaccatcatttttgatttcacctttaccatcaattggctgtccaagggtatttactactctacctaataaacctcgaccgaccggtacttcaagaatacgacctgtacactgaacttccataccttccgctaaatcagagtaaggtcccatcactaccgcacctacagaatcacgttcaaggttaagtgccatggcataacgattacccggtaatgcaatcatttctccttgcatcacatcacttaaaccatgtatacgaataattccgtcacttacagaaacaattgtccctgtattacgtgcttcgtttatcacctcaaactgagctatacgttttttaatcaattcactaatttctgtcgaatttagttgcatattttattcctcttacaatcgcaactcatttgctagacggttgatttgtccacgacaactaccatcaataacaaaatcatttgtacgaataatagctcctgcaattaacgaactatctattctgcaatttaatattactttacgagcaagtcttttttccattgcggtaataattttctgttgctgtgcatcatttaactgttgagcagaaataacttcaacttgtgatagagatttatattcttcaacataagatttaaactcgttaaatacagctggaagtacagctaaacgcttattttcagccatcaacctaactaaattttgcccatattgatcaagttgttcgccacaaattgagataacagtatcagtaagtttaaaagtagaactagtgcttgttaaataagtttgaactttatcatgacgaataagctcagacaaaaactccaacatattagtccatttttctaccgcacttttatctttttcagactgctctactgcaaaatcaaataccgctttcgcataggggcgagctatcgtagttaattccgacatagtctcaaccttcctataaatctgcaactaatttatcaataatgtcattgttcgccgcttcatcaatgttgcgacccacaattttctcagcaccggcaatagcgagagatgcgactttaatacgcaactcttcttgaacacgtttacgttcagattctatttctgcatgtccctgttcaataattttctctcttaatgcctcagcttcaattttgacttcttccaaaatttcattgcgacgtttattcgctagatccactatttcctgagctttaattctagcttgattaatttcttgctcaactaaaacctttgtatcggattgctcttttttagcagcttcagccgaagctagtgcatttgcaatagatctttgacgttcttctatagctttaataatcggtggccatacatatttcatacagaaccacacaaaaatagcaaaagcaatcagctgacctattaatgttgcatttaagttcacaatgccctccctaaaattggatttattcttctaaagaataatatgattatttatccaactttaattagtttaataaaccaatgaatggatttgcaaaaataaatagtaatgcaatacctactgcaatcattgaaatagcatctaaaagaccagctacaataaacatttttgtttgcaagctagctgctaattcaggttgacgagcagatgattctaagaatttaccgcctaaaagactaaaacctatagcagtaccaagtgcagcagctgctaataaaattacagaaccaaaaatagttgcagtaataatgttttccataatattctcctatagatgtagataaaagtttagccaaaagctaagttgttaaaaaatcaatcgaaaatgtttagtaaaaataatttcataaaacagatttaatgatctgatttattataagctatacttagatatactacagtcagcatcataaaaataaatgcctgtaaagtaataactagaatatgaaaaatagcccaaattaaatgcaaaggaatacctaatacttgcggaataatattatctgccatatacataacagcaataaggacaaaaataagctcccctgcgtacatattaccgaataaacggaaagctaatgaaataggcttagccaaaagggtgactgcttccaataaaaagtttacaggaataaatgcccaatgattgaatggatgtaaggtatattcttttacaaaaccgcctaaccctttagacttaatcgtgtaaaaaataattaatgcaaacacacaaacagacatacctaatgtcgcactaatatcggctgtaggaactgctcgtaaataatgaatacctaataactcggcaaattgcggtggaaaatcaacaggaatcaaatcaatagcattcataataaacacccaacagaatattgttaatgccaatgatccaatttgatgacgaacatcacttccgtgaatattatctttaacaacaccatcaacccactcaactagcatttcaactaaacattgaaattttccaggaactcctgatgttgctttactagcaatacgatagaaaaagaaaaggaacaaaactccagatactaaagaaaaaaataaagtatcaagatggacattccaaaaaccttgtccggtagttaagaatgttaaatggtgactaatatagtcagcagtagtatggccagccatagttaatcctttttaaaactaaattttaaggcatttatttaccataaaaggcaaaagattattcaatacaatacttataagataacctacaaaaaaaactttaaaatcaaccttaaatgttttaaaaatgaatacaaccaaaataattgttaagataaacttaatcaattctccactgtaaaacatttttaggttatttttatactttttgttagtaaaaaacattaaatacacaaaaaggcaatatggaataaaaactgaaagtgcaccaaataagaaagataagtacacttcatgatcactcataccgcctatactcagtaaagcaaaagaaaacataaaaataaaaaactcaattaataatgaaattttatatcttttttgagttttttttattacagcagacatcttatcgttctaatttgctacttacaaaaatcttgccagttacaagcctatttttgcgaatttttaacttaaaatcattttataaatgacagtttcgaccatattataaataattcattaaatttattctaatcttttttaacaaaactaaatgacgcttaccaactaattcaggaacattcaattctatgattttatccacagaaaattgagcagataaagccgaaacttcttccatattatattgaccttttaaagcataaaaaaaaccttgatccgttagtaaatgttgacaccattccgtcatatcttttaaagatgcaaaagctctacttaaaaccccatcaaattgatgatcaggtttaaattcctcaactcgacttaaaacaggttcaacattagttaattcaagttcacgaactgcattacgaatgaaactaatacgtttaccgagactatccaataaaaaaaactttttgtcagggttaattatagctaaaggtaatccaggtaatcctgggccagttccaacatcaataaaaatatttccttgtaaataaggacttacaacaatactatccaaaatatgttttaccaacatttccatgggatcacgcacagatgttaggttataagccttattccatttgtttaataataaaaccagctgaactaaccgctctttttgtaaattagtgggtaaaagagcggtattttttaacaaaaaatttagtttttccattaaattcttttgtaaatcagccattattcacctcgtttcagcataccttgtttttttaaattaacgagtaaaatagaaatagctgcaggcgtaatacctgaaattcgactcgcttgaccaatagaaattgggcggtattgttccagcttagcacaaacttcattggataatcccgatatatttttataatcaaaattagcaggaatagccgtattttcatggcgtttttgacgctcaatttcttcttgttgatgttcaatataaccttgatatttaattgcaatttcaacttgttcaacagcttctttgtcttccattgccggtttaaaaggagtaagtgcggtcaaaatttgataatttatttcaggacgacgtaataaatcttccccatttacttcacggacaagtgggctttttaatatttcattagcctcatttaaatattcagaacgaggatgcaaccagattgaacgtaaacgttgacgttccagttcaatattttccattttttgattaaatcttgcccagcgaatatcatcaattaatcctaattctcttgcaattgaagttaaacgaatatcagcattatcttcacgcaacaataagcgatattctgctcttgaagtaaatactctataaggttctttagttcctacagtacaaagatcatcaaccaaaacacctatataggcttgatctctacgaggaaaccaactttctttttcttgaacaaataaacctgcattaataccagctaataaaccctgtgcagcagcttcttcatagcccgttgtaccattaatttgaccagcaaaaaataaaccaaaaatagcttttgtttccaaagttggttttaagtctcttggatcaaaataatcatattcaattgcataacctggtttaacaattcttgctttctctaatcctttcattgaattaacaattttcatttgaacatcaaacggcaaacttgttgaaataccatttggataaacttcattacttgttaaaccttccggttctaaataaatttgatgagaattacgatcagaaaaacgtattactttatcttcaatagatgggcaatagcgtggtccaataccttcaataactcctgtatacataggactacgatctaaatttttgcgaatcacatcatgcgtttgatcattggtatgagttatatagcaaggaatttgctccggatgttgttctacagatcccataaaagaaaaaacaggtaatttttcatcgccatattgtttagctagaatatcaaaattaatagtacgagcatcgatcctcggcggcgttcctgtttttaagcgatttactcttaaatttagatccctaagttttttagcaagatttacagatgcaggatcacctgctcgaccaccagcatagttttctaatcctatatggatcttaccggctaaaaatgtacctgcagttaatactactgactttgccctaaattttaatcccatttttgtttcaacacctgcaatactatctttttctaaaataatatcggttacttcttgttgaaaaatatctagattaggttgattttcaagagcaatacgtacaacttggcggtaaagaacacgatctgcttgagctcgtgtagctctcacagcaggacctttgctactatttaaagtgcgaaattggatacctgctttatctgcagcagttgccattaatccgcccatagcatcaatttcttttactaaatgtcccttacctattccaccaatagccggattacaagacatttgtcctaaagtatctatattatgagttaataaaagcgtttttagtttcatacgagctgtcgctaaagcagcttctgttcccgcatgcccaccaccgattacaatgacatcgtaattttctgtataaaacataatagtctaagtgttattaaaggttttagagttcaaaatagcgatctattctacattaaattacaagataaacaaaaagaagaaagaagtaaaagatcatcagttgatcttcttcttaatataaatagaatctttttatatataaaagtattattatgtatattattaggatctttttttttgttaataagtgtttttttattttttaaaataataagttggatcttttttttattgttatgatctagatcgtttacagtaaaaaatctgtggatatttttatattttatccacaaattttttttaataaaaaacttttttatcttaataacaggaaattttttgttttttattaaagttatccacagagtaatgtaaattaattgaataaatttagattaacattttttaaccagttttcagcaaaatgatcaggatcatcaacattaatgacatctatttttaaactttctgtaatttttacagcttttttattcagtaaaatgtcttcaatttgattcacagcatagcaaaaagtatcataatcggagcttcctaaaccaataacagcaaaacgtatttgagaaagatctaagtttttttgtgtaatttcttcaaataggggttttaagttatcaggtagttcaccggaaccatgtgttgaacttactattaaccaatttttatgtttaattacatcatttagtgaagggccatgtaatagattagtcgatatacctttcttatctagtaagaattgaatatgttcggctacatattctgcacctcctaaagtacttcctgttagaatgcaaatttgtttattcatcttaataccttaattttagttaaaaaaataggcttagaattaatctaagccattgattttatgaatttaaatattatcaatacgacctaataatgaacgtaatcgttcttgccagttatgatgttctgtttttaagtgttcattttcgctacgtaattgctcattggtttgacgagatagctcatttttttcttttaattcttcaatttctaattgaagtaattggattgtttcaacagcttgtttaattttttcttctagttggtctaaaatttctaaagacatgatggtttccttttaaataaaactaatttgtgtagttattctaactcagttgtctattatttttaaggaaatttatgaaaaatttgcatgttgtatggcattgtgcaatcaatccattatttgtaatagaaaatataccgctctttatgttttattggagtataacatcagcagtaagttgataaaaattagcctattaagcaaatttttgctataatccgagccagtttttatttataaaaaagagaaattttatgtcagaaaatacaactgaaaattatggtgcaggaagcattaaagttttaaaagggcttgaagcagtacgtacacgacctggaatgtatattggtgatactgatgacggtacaggcttacaccatatggtttttgaagttgtagataatgcaattgatgaagctttagcaggttattgtaaagatattattgttactattcatgcagataactctgtctctgtgcaagatgatggacgtggtattcctgttgatattcatcctgaagaaggtgtttcagcagcacaggttattatgacagtattgcatgctggtggaaaatttgatgataactcctacaaagtttcaggaggattgcatggagtagggatttctgttgtgaatgccttgtcggataaattacaactcactattcgccgtcaaggaaaagtgcatgaacaattttaccatttaggtgatccacaggaacctttatccgttattggtgaaacggaaaaaacaggtacaactgtacgcttttggcctagtcccactatttttactaatattgattttgaatacgaaattttggcaaaacgtttacgtgaactttcatttttaaattcaggtgtatcaataaaattattggataagcggaataatcgtcaagatcattttcactacgagggcggtattaaggcttttgttgaatacttaaataaaaataagacaccaattcatcaaaaaatattttattttagtgcggaaaaagacgatattggtgtagaagtagctttacagtggaatgatagttatcaagaaaatgtttattgtttcactaataatattccacaacgagacggaggtactcatttagccggttttcgtggtgcattaactaggattttaaacaaatatgtagaagaaaattcgaataaaaaagacaaaaaggatatagcaacttcaggtgatgatgcgagagaagggttggttgctattgtttctgttaaagtaccagatccaaaattttcttcacaaacaaaagataaacttgtgtcttctgaagtaagagctccagtcgagtctgttatgagtgattatttacaagaatttttggaagaaaatccaaatgatgccaaaattattgtaatgaaaattattgaagctgctcgggcaagagaagccgctcgcaaagctcgtgaaatgacacgtagaaaaggtgctttggatatagcaggtcttccaggaaaattagctgattgtcaggaacgtgatcctgctttatctgaattatatcttgtagagggtgattcagcgggaggttctgctaaacaaggacgtaatcgtcaaaatcaggctattttgccattaaaaggaaaaatacttaatgtagaaaaagctcgatttgataaaatgttatcttcccaagaagtgggaactttaataaccgcacttggttgtggtataggcagagatgaatataatcctgataaattacgttatcatagtattattattatgaccgatgcagatgtagatggttcccatattcgtacattgttattgactttcttttatcgtcaattgccggaattaattgaacgtggtcatgtttatattgcacaacctcctttatataaagtgaaaaaaggtaaacaagagcaatacattaaagatgatgaagaaatgcaacagtttgagttaaatttggcattggaaggatcatctctttatgtaaatgaaaatgctccggcaatgaacggaatagcattagaaaaacttatttcggaatataattcagtacaaaagatgattagccgtttatcttttcattatccagaaatattattgaaatcattaatttatcaaaacgcattaactaatgaaataatggctgatgaaagtgcggttgatttttgggctaaatctttagttaatattttaactgacaaaaaaataagcggtagtagttacaaatatcgtattgtatttaacaatgaacgtcatttatatgaagtagttatcattattcgtacccatggtatagaaaaaaattattttttgaattttgaatttttaaatggaactgaatatagccgtattgttaaattaggtaaccaactacagggtttattagaaaaaggagcttatgtatctcgtggtgaacgtcaacaatcggtttcgtcttttgaacaagctatcgaatggctgacaaaagaatctcgccgaggtctgattattcaacgctataaagggctaggagaaatgaattcagatcagttatttgaaacaactatggatccaaataagcgtacaatgttaaaagtatcgattaaagatgctgttgcagcggatcaattatttaccactttaatgggagatgaagtagaacctcgacgtgaatttattgaaatgaatgcactaagagctaatttagatatttaattttattttttatttatcaattttggaattaatagaggtttttgatgtgtacagttatgcagaaagaagtattaattgaaatgattgctaatactatggctacgatcaatgtaataacagaacctaaagcagaaaataatgaggatcagaattatttgatgaacttaagaaatgatttgtatagtactcatcatgatgacattgattataatctcttatcaatgacagtaaagaatatcaaagataaatatataggtttgcctgttcataaatattatgcgtaggtgataagcataataaataatctcttgatttgtatgaatattatttgtaaataaaaagatccccttaaaaagggggatttttatttttttgttgttctaaaaaattgatgttctttaattaacgcaagaaagggttgagcaaaacgttttaatttaatatcgccgacaccattaatttgtatcatttcttgttctgttattggttggtattgtgccatttcttgtaatgttgcatcgttaaatactatataagggggaatattttctttgtctgctatttttttacgcaaaaaacgtaatcgagcaaagagatctttatcgtaatttgtgaccgctctttttggtatagtaacggcattagcaatagaggatattcttggtgttgctaattgcaatggttgttcacctcgtaaaataggtaatgcctctaatgtgagttgtaatgttatattaaaatggtcaattacttgttttatcagacctaaatggattaattgtcgaataactgattgccaatattctctactacgatctttaccaatgccgaaaacgcttagtttatcatgttgatattctttaattttttgattttgggaaccacgcagtacagcaataatatacactgccccgaaacgttgccccactcgatagattgctgacattactttttgtgcatcaaccaatccatcatattttttcggaggatctaaacaaatatcacagttattacaaggtttttgttgatattcgccaaagtaatttaatagaactaaacgccgacaaatttggctttcagcaaattcccctatggattgtaatttatgtagttctatttgacgttgcggtatatctggtttttctaaaagtactttttgtaaccaagcgtaatctgcaggttcgtaaaataagacagcttcagctggtaaatcatctcgccccgctcgtcctgtttcctgatagtatgcctcgatacttcgaggtagatcaaaatgagcgacgaaacgcacgttagatttattaattcccattccaaaagcaattgttgcaacaacaatttgtacattatcatgttgaaaagcacgttgaacaaattctcgttgctcattactcataccagcatgataagcttcagctgatattcctttttggcgtagactttctgcaattcgttcaaccttattacgactattacaataaataattccatttttccctttttgttttgcgataaattgagaaagttgctccataggtttaaatttttcaactaaggagtaacgaatatttggacgatcaaaactaccgatataaatatggggattagataatttaagatgaataaggatatcttgtcgggttgcctgatctgctgttgcagttagtgccattattggtgcatcaggaaaacttgctttcaatcctcctaattgagtatattctgggcgaaaatcgtgtccccactgtgaaatacaatgggtttcatcaacggcaataaaactgactttgcaatgagaaataaaatgaaaaaagctggttgttaaggctttttctggagatatataaagcaactttaattttcctgacattgctttattttgaaccaactgttgttgttcaaatgtttgactggaatttaaataatcagcatttataccatttgctaataactgatctacttggtctttcattaatgaaattagaggagaaatcactaaagttaaaccggagaaacaaagagcgggaatttgatagcataaggactttccgccacctgttgccataataactaaactgtcctttttagctaaagttgcttcgataacttccagttgtcctttacggaaggactgatacccaaaaacagaatgtaaaatatcaagtgcggtagatttttccacagaatcttggctaaaatctactgcacttttttgttgcttccattcttcaactgacattaagaaaaactcacctgttcaccatgagccaaacaagcttgttctaaacattgccaaaacaattttccatcctgagcaatccattgattatttttaaaggcaaaatgaaaacctccagccttgcttgcaagccataattctaataatggttcttgtttatttacaacaatttggctacgatcaacgaaagtaatagtaaaaaccgaaccttgagtatcacagtctacatcacaaccttgttcttctaattgttcttctatttgcaaccaaacttgttcgatattttggtgatattctgctatgttcataaagtttacctattaataaaaaagaataacaaaagattataaatatttttataagatagtgatagcacaaaggcatttttaatggtaaaaagtgcaagttttttaattaacaaggacataagcaatgaaaaaaataatttcaattttattacttagtgcaatagcttttggtgtgtcaggttgtggtgttaaaggatcattatattttccagaaacagaacaaaatcaacaaaaagttaattcaaaattaaagtaatcaatatgtaaggataacattatggatttttttctatataaagatggacacttaatggcagaaaatgtctctgtgaaaaaaattgcagagcaatttggcacgcctgcttatatttattcacgagcaactctagagcgtcattggcatgcttttgataatgctttaggagatcaccctcatttaatttgttttgctgttaaatccaatcctaatatagccattttaaatattatggcaaagttgggatcaggttttgatattgtgtctcaaggtgaacttgagcgagtattatttgctggaggtgatcctaaaaaagtggttttttctggtgtggcaaaatcagaacaagaaattgcacgtgcattggaagtaggtattcgctgttttaatgtggaaagtgcggctgaattaataagaataaatcaggttgcaagaaaaatggggaaaattgcctctatttctttgcgagtaaatcctgatgttgatgctcatactcatccttatatttcgactggtctaaaagaaaataaattcggtgtaagtgttgaacaggctcgagaagtttatcgccaagcaagtcaattggaaaatataaaaattgtaggaatagattgccatattggttcacaactgacagaacttcaaccttttttagatgctacagatcgtttaattgttcttatggagcaattaaaaaaagatggaataacattagaacacgtggatttaggcggtggtttaggggtaacttatagtgatgagaaagcaccacatccaagtgaatatgctacagctttgctggaaaaattaaaaaattatcaaaaattggaaattattttggagccaggtagggcaattaccgcaaatgcaggtattttactcactagagtggaatatataaagagtaatgaaagtcgtcattttgccatcgttgatacaggaatgaatgatatgatcagaccggctttatatcaggcttacatgaatatcattgaagttgaccgcactttgtcgagagaaactaaagtatatgatgtagtcggtccaatttgtgaaacatcggattttctaggaaaacaacgctctcttgcaattgcacaaggagattttatcgtacaacgatcagccggtgcttatggtgcaagtatggcatcaacttataattctcgtccacgagctattgaaataatggttgatggagagcaagttcatttaattaaacgtcgagaggagtttgctgaattgtggcatttagaaaaattactggaaatgtaaatttttctcgtaaatttcaactaactaaaattgagtttttattctgttgttacactgtgtttttggcaacaaaaattagaatataaaataaaacaatataaaaaactgaataattaaaaataaacaatatttaattccaattaaatataattaattaataaaaaaagatatttaatctaaatttttgttgttgactggataaaatattttgttatattgctaaaccttctgtaatgaaataaaaaatataaaaggtctataaaatgaaagatacaacacaaaagcgagaaacattttccggtcgtcgtgcatttatcttagcagcgattggatctgccgttggtttaggaaatatttggcgttttccttatactacttatgaaaatgggggtggtgcatttatcattccttatttaattgcgttattaaccgcaggtattccattacttttcttagattatgctattggacatcgtcatcgtggtggtgcacctttatcttaccgtcgttttaacccgcactttgaaacatttggttggtggcaagtattggttaattttattattggtatttattatgccgttattttgggttgggctgctagctatacctatttttcaataaataacttttggggagataagcctatagagtttttcctgaatgaattcttaaaaatgggtgatattactcaaggtgttagttttgaatttgtaggaatggtgacaggtccattaattgctgtctggttgattgctttaggaatattagcactaggtgtacaaaaaggaattgcaaaatcatcaagtattttaatgcctattcttgtcataatgtttgtaattctcgttgtttcatcattatttttgcccggtgcggaaaaaggattagatgcgttattttcaccagattggtctaaattatccgatcctagtgtatggattgcggcatacggacaaatatttttctcactctcgatttgtttcggtattatgattacctatgcttcttatctgaaaaaagactccgatttaacaggtagtggattagttgtaggttttgcaaatagtagctttgaattgttagcaggcataggcgtttttgctgcacttggttttatggcagcgacagcaggacaggaagttagtgatgtagcaaaaggaggaattggtctagcattttttgctttcccaacaattattaatcaatcaccttttggtgaatttattggtgtattattcttcggttctttaacttttgcagctttaacttcatttatttctgttattgaagtaattatttccgcagtacaagataaactaagaatacgtcgagtaaaagttacttttattgttggtttaccaatgatgttttgttcagtgattttgtttggtactactacaggtttaccaatgcttgatgtgttagataaatttgtaaactattttggtattgtggctgtagcatttgtttcattagttgctattgtttccaacgaaaaattaacttcattgggtaatcacttaaatgaaacatcttcttttaaagttggttttatctggcgtttatgtattgttttaacaacaggtattctagcatttatgttatttagcgaaggtgcaaaagtattctctgaaggttatgaaggttatcctgcttggtttgtaaatatttttggatggggtatgtcgttaagtttattagttgcagcattcttactttcccgtttgaaatggaaagatgaagcattaacacacaaaaaaggagaataaaaatgagtaacagtgctattatgatgatgatcatctctttggtaattatttggggtggtttagttgtatcaatattaagattacctaaagaatgataaatttcaaataaaaataccgcactttgatctgcactctaaaagatagggttaatttcccatctgattaaagtgcagattttttatgatttcatattaatagtagtaggttataaattccttaaccgtcatctattctcgcatgagtgatgacagtaaaattatgctgaaatagcaattttcaaggtgagttcatgggatgggtatcgatccatcattgatcatcatcaaccaagttaaacgaaaacagtatcgcaagtgcagtggagttttttgataacatactctttggttaataactgatttaaccttaataattttttgagtctagttttagttttgtgacaatgaaaaaatcccaaaacttgaaataaaaaatgattttatattgatttagtgatgaatcccctgcttttaaacaggggagggtgattttattgtaaaagtataatctcaacaggttttaatcctgctctctctagacctttattaagtttctttaaagcctgttctttttctgttttagtcaatacattgacattcttgtataaaagtgcggcagtaagattccaaaataaaatgagatttacaggaatacctgagagttttaactctatgtagcaatttgctgctccttttaatttaaaggattttatatctttaatgtgtattttagaaagaagcctttcgtgttttatcgaaagatttgggagatcttttattctttttttccgagcaagttcttgtgcaattttctttgctctagtttgagcaatagatagatagagaatttgacgaaaatgttccttattctgtgtaatttcttttggcaatagataataatttcctatatttagttgagggtttggggttaaagctaaatatgataaagcacctaggctttctaggtatttagctaattccttctctgctcgaatataaaattttccttgctggtataaaccaaacataagacctttcttaaataaaccataaccagaaaaaagatttttcacagttatagttcctatcaattcggtaagttcacttctaatattttcagtgtcttttaatgatttggtcatatataattcaacctcatttattgtgacaaaataaataaaaaccttttgattagaaaaaatctccaatcaagataagttataacacagagagtggattttattttaaataactttctaattttgttaaagtttgtgatagagatcgagaatttataaaaaagtttgctattttctttagattttttagagaaatgataaaatgtgctaccgatggtttacattatcattataattgtttaaaaaccaaacaaaaagattaaaaaaagagaaaattaatcaaattttgataaaaaatataaaaaaagcttgcgttgaaatataaaatgcctataatgcacggcacacaacgacacgctgttgtgagaggttaagcagtgtgtcgttattttttgttctttaacaaactatcagacaaactgtgtgggcacttgtgagactgtattaataagagattaaaagagtaagataagtgcttaaactagagaaattcatagagaaaagatggatgaaatagtcagtatttattgagcgaagagattaaattgaagagtttgatcatggctcagattgaacgctggcggcaggcttaacacatgcaagtcgaacggtaacggggagggagwttactttctctgctgacgagtggcggacgggtgagtaaagcttgggaatctggcgaatggagggggatagccacgggaaactgtgggtaataccgcgtaatgtctaaggaccaaaggggtgggactgagaggccacctgccatttgatgagcccaagtgggattaggtagttggtgaggtaagggctcaccaagctgacgatctctagctggtctgagaggatggccagccacactggaactgagacacggtccagactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatagaggaagaagcgggacaggatagagagaggaagacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgatatgaccctgggtggagacactcagggttttttgttatttgggataaggcggggaagagagaagagagaagaggaaactgggagaaaaaaagtaataaggtgataacgaggtagtcataaaaagtagggtaatgaagcagagtgaagaggtgcggtaggaaaattgtttttttttctaccgctctttttttaggtgatttatttttagcgatttgcttgacgataaatgatgatcagctactgaacgagaagttacttctagcacaacatttcaaacagaattttctctatagatttctttaatttacaatgggttatcttcatttatagacagatatcattgctaatctacttcagaccattgtaaattttccttattgtcttattaccttgtaggtaaaagtgcgattaaaaaatcatatgtttctttagccaatgaattactgtatgaatgttttgattgtgtttgtaaggtgttacaatataataacgctgattacacggtttttctaagcctttgaaaggggttattaattggtcattaactaaataaggtgtgattaactgttttcgccccattgcgatgccaatatggttaattgcagctgttaatgctaaattcgaacagtcgaataccatagattgtacttggtttaaatcaagactgtaattgaaatatgttaaccaactctcccattcttcaaaatcggaattgtaatgccacgcttgtccgtcatgaagcaataaacagtgttctaaagatttcggattcccatgaagtttatgtttctcggcatattcagggctgcaaaccggaataacgctttctggcatgagttcatagtgatgtaaattttcactatataaatcatcataatagatagctaaatctactttatacctattaaaatcaataacttcattgccagtcaaaatattcagtgtaataaacggatatttttgattaaatcctgctatagcaggaataagccaactttgagctaaggaagggcgagcataaattgtcaatgtgccactgatttcttgattacgtatttcaaaaatttctttatttatgtgaggtactaactatttttacatagataaaaaacaaaaaatttggtcggaaaaattgcggtggggctttgtgtggcaaggctttgccgttttttgtttgggggagttatgcaaaaaataagaatggttaaaaatggtaaataatgggtggtttttgcattattttttgcataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatacgcccttgtatcaatgcccgaagttatccaaaccgaaatccgtaagaaatttgcggtcgatgtagtgaaagctcaaccgaaacaactcccctcagtgcgtgcagaagtggatttggcgaacctaactacaaaacaacgcgagatagcagatgctcgaatggcgttagtgcagtatgtgctagagcttgaacagtcaatgagtcgaattaaagcggtgacttatttatgtgatcttgcaaaaaatggcaagttgcctgcacaccttgcagagctaattgaagtggcgaatgctaagaaatcagctaagcggacactaagtgtgcgtaccttaaatggttgggtggtggattactgcaaagccaagaatgtagagcaacgtttgaaattgcttgctccacaagtgaaacaggcggttaagcctgaagagatttggtggctaacctcttttttaggtgtttaccgtcagaaaaatgggatttgtttaacggaagcctatcgtcaatttaaagttgaatgggcaagtaattatcaagaaaacccgattttactcgcagaaatgccaagtttgagccaagtgcaacgagcgatggcaaagctaccgctctatgtaaaagagtatggcagacgaacaggctcacattacaaaacgttattaagttatgtgaaacgggattggtcagcattaagagcaaatgatgtgtggattggggacggtcacgccatgaaactgaaagtggctcacccaatacatggcaagccatttacccctgaattaaccatgattattgatggtgcaagtcgaaaaattgtggggtggtcgatggcattagcggaaaacgcttttgcagtagcagatgccctacgccatgccatatcaacccatggtgtcccagctatctactactcagataacggtggtggggaaaagaataaatttttagatgcggaagtaacggggatgttaccccgcttgggtatcaagcacgaaacagggattgcaggtaatccgcaagggcgtgggattatcgaaagattaaacaaaacagtggggttattgattgcacgccagtttgagacttactacggcacaggggcagaccctgaaaccactcgcaaggtgctttacggtgtgaactctttggctaatgcgaaaggcacagtgcttacgccagtgcaaaaaagagcgaaaggcaagctcccaagttggcaacagttactggatatggtgcaacaagtggtcgattggtacaaccaagagcatatccatagcgaaattagatgtataccagctaagaaatatcagcagatgttacacccagaagatgtggtcatgctgacggatattgaattgcgtgatatgagccgacctgagtttatccgcacgcctgagcgaggttggataagttggtgtaacaacaaatattttaataccaaattattagcgatagatgggcaagaagtagtgattggaattgatatccataacgccgaaagcatacaggtgcgaaccaaagacggcagatttgtgtgtgatgcgatttggaatggtaacacaagagaagcctttccagtggcgatgctggagcagcagcgtaaagaacgccatcaacgtcgcagtaagcttaaagagcgacaactggcagagattgatgtggagcttaatcctgttattacgattgagcataaacatgattttaacttgttggcaacagcaagtaagccgaaaaaagagcctgtgccgttattttttacacaggcagaacgagaagattacgaaaaaaagttagcgataggaggctaaaaaatgaaaaaccaacagcttaaagaatttatgcaagcccaagggttaggacaaaagcaagtagcgaatgcctttggtgtatctgtggcaacagtgagccaatacttgagcggtaaatatcaaggcaactgcgaagaattagatcgcaaagtagatgaaatgctcgaacgccagaaagctaaagtggttgaggctaaatataacgctgaatttgtaccaactttagcggcaaaacgtggaatggaagtgatgcagtttgcccacgttgaaggtgaaattaatgtgatttttggggcagcaggtttaggaaaaacgcaaatgttgaaagagtacgctcgaagaaatagctctgcggtgttaattgaggttgatccgagttgtacaccaaaggtattgctacgaaaaatcgccgaagcagtaggagcaacagcacgaggaattaataatgagcttctcgacagtatcgtaaacaaactcaacggctcagaacgcttattaatggtagacgaagcagaattactctctacccgctcgctcgaatttatccgccgtatccacgacttgaccggtataggggggtcttagcaggcatgccgagattattagttaatcttaaaggcaaaaataacgaattagcccaattatatagccgaataggttttgcgtgcgatttgggtaatgccctacctgatgatgatttagcgttattggctgaatctgcattaggtacagatgagtttaacgcaccactgattaaagcgtgcaaaggtaatgcacgccgattaagcaaactgatgcgtggcgtggtgcggtcaagcgaaatcaacggcataccaattagtgccgagctggttgagcgttatgcaggtatgttgattagttaggtgacagatgacgtaccgtcaaatttatgcggcgtaccgtggagatgagaacgtggcagacggtacggcggaagaattcggtattatgtagcagttgcacaaaacctaaaatgcaatctcaaccgcagtaaaatttttgatgcccttaatcgttgagggcatttattttggtaaattttagctgattttctcacttgtttgccaatgttattggcttgcgatgtaaattttcccatcaatgggcgtagtcaatccgcttaaccttgtcaaaggtaagctgattcccctgttcattctaattagttttgtaattaagaaaattaggctgccaacaactcttgctcgtacttcattctttcattgagatttttgaagtaggactgggaaatttcttcagggctaaatgcggtcatactgataagctcttgcgtgcgatgattcccttgccagtaacccacccattcccttaatggtaatacccataagcaacgtttgagaatatcactaaataggtcgccattagacttttgacgattatctgacataaacgccacttggttggcataatgtagggcgtatttattatcacatttgtgatgtacaccacgatgtaaatcacggaaacgagcattaaaggattcggcgagattattactcacacctttggcactataacattctttatgattaacactccaacgagcgtagtgaaaatccaaacctttataggctagattttcatcacacataatatcattgccttgttttacgaattgatggtttaatgccaaaattgttttagcattttcagtatagtccattgtaacgatggtgcgatttgaaccccacaatgtttcatcattagaagcacgttgatttaggctgataatgaaacgtttagttggtctcaatttaggatagtttgtctttttatctcgttgtttatgttgattctttttaaaatttgctttgcgtagcttatagttaatcaacgtcccatcttcgtgaatttccccttgcaatggcgttaaatctcgagttttgaatagggcttcacgcagtttatggcaaaggacaaaagccgttttataactaatattaaggtgacggctcattgttattgctgaaatccctttgacttcattcgcaaagagaagaatggcagccaaaatatcaacaaacggtagtttatgaaaagcaaatgctgtattagttgtaatatagaagtggcgttggcaatgtttgcaacaccaacgtttgcgagattgaagaaagtaagcattgtggcgaataccgcaatgcggacaacaaacatcgtgaatattatcaggattaccccaacggtttgctttcaaaagttggaaggcttcatcttcacttaaacggaagatatgtttaagggataatgttttagatttgcttgaaagtaagtaatgagccataagtattccttgtgtgtacaaggcactcaaagctaaacgccagacataaaaaatcgcccacctgaattttcaggtcggctcaaagcgttttgccctgaataccgtactgtcacaagaaatacgtggactttaataaatgagttgcaaaccccaaatagtcccctaataaaagggttctacgcctatatggttcgctatgcttctttgaaagaaactaggctaaatataaataaatggttcattggcaaattgtcattgttcatcaacgatgaacggcattcaaaatagatctacgttgtttttctgtcaaataaaaaagcaacccattgctaggttgcttatgaactgtgattctaaaaaatggatatataacaagttaataaacactaacctgattacctttaatactcacaatatagttatgtgtaatatagtctgcactacctgataatctgttaccaatagaattagccataattctacacttcttcacaccgttgttatcagatatttctttagattcaaaagaagaaaatgcaatataattctgcattcttgttataccttcagcaatacttcctgcaccttccattgctcgaccaaacatatcccagagtggattagagcggtctaacccttgcgtagcgtgccctacaaaaaattgagcgagtttatttgcttgaacattttgagctcggattccttcgttaatgaatctgcggactgtttcttcaacaacataatcatcgcactcaatttccttttgaaaggtaggtactagttgtaaaggcgatatactaggcactaaaacatctatactaaatgcagtagcaatcactggaaaaatatattttccaaacttagaaaaagccattctattctccttgttgtttttcaggattttcagactcttttttctttaaactaggtattttgctaaataattctttaggatatgtgcatactattttcaggtatgtttttagaaattcggctgaattagcatcaagatgagatgttctacgatgtgcaatatagcaaccaacaataaggtagaagtaaatcagttctttcataatgtttccttataactaaaaatcaataccagggaaaaccttgtatagtatgtgtacagtctgatgtagtaactaacggtgtatatcaaccacactagttgtgggtacactcatcaattagtgggtaaaaaatgaatatcaacgagaaaatccgaagaatccgtgaatcaaaagaatggtcgcaagaacagatggctgaaaaactgaatatgtcattaaatggctatgccaagattgagcgtggtgaaacaaagttatacttagacaagttagagcaaattgctcaaatcttagatattgatgttgttgagttaatccaatcaggtgagaaaaatatctgctttcaaattgaatcgccgttaggttcggtgtatcaaggtgtgggggaatcatcgctgttgattgagattgagcgattgaagttgaatctttcgcatgctaacgagaaggaaaatttattgaataagttgcttgagcagaaagataatgagattaatgcattgaaagatttactaaaaatggctatgcccgaataaaacatataaaaacattgtgttctatcgtagagagataagataacagttgaattctattgggaaaaatatttaaggaataaatgtgagcaaacaaattaaacttagagcatttgaaattgtaaataatgatattagtaaaaatcttcaagtcgttaatttactcaaacaaaaattagatagttcaacttctagtaatgagcgtagaatgcttttaagtgaagatgatcctaagaaggaagaagatttaatttctcacttcaatactgatagaaacaacgttgtttttgcaacaatgttacgtattgcactcggtgataatgttcagcatatcgatgagactctttttcagaaagccaatttttcaattagtgacttactgaatgctaaacttaatacaagtgctatatataaagatcactactattttttgctatctgatcgttttgttgttacaaatctatctagcaggacgacaattactcgcttacaaacatatttaaactggtttctcggcgagttactagaactcaatccgataattgagcttaaagaagaatatgatttgagtaatgtaagatcactggttattcaagatcctgagaataagaatactacaaatattgacagtacggctaaagataacacgaactcaactgtggtatccaaattcaaagacattactcactttgcaatagaacatgtgaaagagctatttgctgatgcagaagatttagatgaaattgattttagtcagttagtttcagccaaactacttattcaaataaagaaaccaactaaaaattctccagaagatgttaaaaaagcattttcagcaatgttaaaacctgtatcagatctagataatatctcatttaaaactcgtaatggcacatcagttacaggaaaccaacttcagaagattaagcaagtagaggtagatactactgacacaggtaaattaaatgaacaaacacttttccaacaaatggagctttttataaaagaactcgaaaatgcaaacaaagattaaatggatagtaattagcttaatcacatttttattatcattcatcttatctccttttcttaatcaagaagataatatgaatcaagctattgtgcctaccatttacacattgtcaggtattatgttttctattggaatgggaatcgcttgtacatttaaccctagccaaattagaaatgaacaagtttttcaacgagtcaaaaaaaatataactaatgtaagaaatacatttttaatgtattttatgctatctacagttacgtttttaattagtcaaaatttagctagaaaccatatttccgtaatgaactttactttgatatttgatcctaaaatcttggctttattattttctatagtgagtcttatttattttattgttaatttccttactatccaaaagttgatttttgatatagccgaaagagctatgaatgaaagtaaataagtcaccttctcagcggcttatttatatttcatttttattacttcaatatttaagtaaatcatctaatttaagacgttcttaattgaatgagcgaaatttagttatgagaaaaatttggtaggaaatcaatagaaatatttcttgatatattcataactaaatacctgtgtctggtgtattatctcagaaacaggtatttacaaaaattgtgggagagttctcacactaacactatatgactaggtcgtttttctacattaaaagtattgtatgtttcaatatcatctttattagcctctaaaaaagctttgagagatactgttcccattttcaatctatctacaaaggattggattgctttcctttcctttctgattcagataataatggaacaactatatttttagcatcgctagagcttatttctgccaatccatctgagcctctagctaatgatctcatttgaatagcccatgcttctgtattcaaaaaagcgagaagatcagctaaaaatacttctttgcctttttgtatgcgacacctgtgacaaccattagtgactattatatcggtttgatattcgcctatataacaccattttgccgcacttccccaaattgaaccaaaatacaaatcatgaggctcggaaaaatgtttagccctactaggtaattcccaaccatacatttcttgacttgtaaactcaccataagaaatatcttctaatatgaacatatttataacgatttatcccaattaaactattcttctctccagatgaagaaactttttcaggaagaaaattaactatatctcccaaacgtaggtgtggtcttaattttatattatatataatatttttcactatttgatttaagtaaatctgaaacattatcagttctaagccaactaaaataatttaaagctgacatagaatatcttattctatctaaaactactggaaaatcagtgtttagtacaagctctccatttttatcagatataaaactaccatcaatgggatttcttttatatacaggtttggctattttatttcctgcttcccaacctaagttttcaatagattctataaagaaactataatcttcagaatttaacgatgattttagtggttcttttcgtttttcaagaaacaatatactggcactaacatctgcaccgctgcttttaaagctaaatctaggtaaagcacaaataccagctatcttaacatggcgtaaaagccattctctaaaaattaaaaatttttcggaatgattccctaaataaccattaggcagaattattgctattcgtccttctttttttgcttttctcacgcataattctacaaaaagaagccctgattcctgctgtgatagcaatgaatttttatctaaaataaatgtatttttttctaatatccattgaaaccctaagtcaaaatttttaagaacctcagttcttctttctaaaatcttactaccaaacggaggattgcataatattaaattatattgtttataatcatcatttattgtttctaatgaatcaattttctttatattggttttcccatctccatttaataccatatttaatatagctacttgaactgcattatctgagttatcattaccccaaatataatctgcatgcccatgattaaattttctagcagtttgaaatgctgcaaccaaaaaatctgcgctaccacaagcaggatcaaaaacatgctcgccaaattttaagttcatcacatctacaataaagtctgttatcggtgttggtgtaaaaaactgtgcgagatcccacttataaagtgattttgcaaatttcatataaaatgactgtattatatctcttttagaatatgtaattctgatgggagataatacttttaatatatctaataacgcatcattttttattttaaaatcaggagtcaacggttttggtaaatgagaaccgtaaaaatcaataactcgagctaaaagatttttaaatctagggatagaaatgttatcaggtattcctaaagatctaaaatcttgaatttccatagcttcatgaggttgtccttccttgctatgttcatcaaatatttttaccaataaaatctttaagattaattcatatcttgcagaaatatcaaaaccttgttgatgaagagtattttcaatataatcaaatatttcaattaagttattgtttggttttgtttcattaaatgaaataggttttatatttatggaagcaccaaattcaggtaatagatttattaaaccctctctaatttcttttttatcatttgaaaaatcttgccaaaatactcgttgttctaaattatcccagtataatcctaaacatttttggatgtttagcaaaatctaaaaatggtttaacttgagtttcttttacatagtctgattttgaattatctttttttacttcacatagtataatcgcatgttccaaaattgaatcgacatcatttgtaattgtaactttatcaacatctaatacagcgagatcacatctaaagttatttctaccattattaccaaatttcttaactatttgttcgataataatattttgttttggataaccttgcgataataaatagtgtattgcctgtattctataatattcttcagtatatgttagcttatttttagatttttgagatgtttttaatacccctcgtatagggcagatgagttgaacttgctctactgacattatgccaccgcctttttcacagttgcatttgacaaaaattgaatggagattaagctattgcgttgcgttgaacatttttgagatccttattttagtatatcaagtaataattactgtttctctgaaatttctttaaaagaaattgagaaagcatcttttaagttttcaggcatagcacggtaatctgaaattaatttcgtttcttgctctgacattacagttttttgttgttcagactgaaacatttcgccttcaccacttaccagccagttcaaattcactccagctttagcaatggcagtcattccttctgcattaggttcacgttcaccgccaacataaccttgtagtgtgcgataagcgaccccgtctgttctgcaaaatctttaattttccagttttttgcttcacaaacttgtcttagtctttctgatatgcacatttgagcgttccattttcaatactagattgaaaaataccgcaaacgagtgcatatttgacattgaatgaggaatattctatcacgtttgagcgtgtatgaaatactctgataacataatttttggggctgtattagattagtaagtatgctagtctataaaaatgaaaataactcattgtaaattaaagaaatctatacagaaaaagctccttgagttttttgtgttagaagtgacagctcgatcagcagctaatattttaggtatcaatccaaattcaagtgccttgttttatcgtaaaattcgtgaagtcatcagctatcatttagcccttgaagccgatgatgtttttgatggacagattgagcttgatgaaagctattttggtggtcatcgtaaaggaaaacgagggcgtggagcaaccggtaaagtggctgtttttggcttgttaaaacgacagggaaaggtatttacggtggtggtagaaaataccaaaaccgaaacgataatgcctgtaatcacaaggaaaatcaagcctgacagttgggtttataccgatacatatcgtagctatgatgctcttgatgtgagccaatttcaccacgaacgcatcaatcattcggagttgtttgcagtgaaagaaaatcacatcaacggtatagaaaacttttggagtcaagccaaacggatactccgaaaatataatggaattgaccgaaaaaactttcctttgttcttgaaggaatgtgaatttcggtttaactttggaacaccaaaagagcagttaaaaacattgcgaaaatggtgtggaatttagggctgatctaatacagcccctaattttttggcaattaaaagtttttacggcaatttaaatttgcaatctaaattattaaactaatcagacatatatcatcagaaataactacaatgacccagcactttcttttaaccagcaaagctcgcacgctttcatctattaagatagctcgcctatctgacgatgaagcatttagcttattatgcgagctacgctggggggagtaaagaagtggtggtttgccctaaatgcggtgtacaacataaagcctactttatctctactcgcaaacaatggcgttgcaaacattgcaggcacacgtttagcattacatcaggaacaatttttgcgaatcataaactgccgattcaaacctacttattcgctattgtattatttgtaaatgtggttaagggaatttcagcctgccaactctctcgtgatttgaatgtacagtacaaaaccgcttttaccttatcacataaaatccgtgaaagcctgattgtacaacgtgagctttttccactttcaggcgagattcatattgatggtacttacgtgcattccgctccacgtccaaagaataagaaagttgaacgtgtagatagacgtttaaaacaaatgctaatccaaacaaacgtgcggtattggttatgcgtgaacgttacgctaaacaggaaaccttatctaatccgcagttagttggagcaaaaaggaccatcacgtttcctattttgtcagaaaacactgaaaccgtgaagaaattagctcactcacatattgagccaaacagccgtattcataccgatgaaaacagtgcttatgatgaattaatcgtagattacaacttacaacgtgtgaaccatcaaaaagaatatcgcagtgatgaagggattaccaataaccttgcagaaagttactttagtcgctttaaacgtatgtactacggacaagttcataaaatgagtaatatttatctcgataattacgcaaacgaaatagcctatcgggaagatactcgcaaactggataatttaacgattttcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaacgagaaaaagagcaggtataggctcacctagctctagttgaacgccgtattactttacttcatcaagccttagacgtaatgaacatcggtgaagatgaagttcatcaacacaacaccgaacattttaaatatcgagtttaccataaacgctttaacggcaaattaagccaacttatccaacaggtgatgaaagctgaaccacatcgtttttggcgggcagaagaaataacagaagcggtactcgttgcagataaacaagcccatcgtcctattactaaagattatattgagtctgtccgctccgcttgtgaacgccttgcaagacgagagataatagagagagttgaagttgttcgatacaaagtgattcaatggaaatggaaacaaagatagcggtagaataccactatcagaccgctgacaaacctccagacattgctttggaagtttgatctaataggcacagaaaaaaaagaaatgcctatgcttaaaaatatcgcctctccctgatacgaactcgagatgataagtcttgaacagcgtattcccaaagactatctcgtccgcaaggttgctaaagcgattgattttgaatttatccgtgatgaagtcgctcctctttattgccaagacaactgccgcatggctcttgatactgttcatttgtttaaaatcatgttattgggttatctcttcggcattaaaagtgaacggcagttagtaaaagatattgaagtcagtgcagcttaccgttggttcttgggaatgtgattaacagaaaaagtcattgatgccggtcccctaagtcaaaattatcttcgctgttttaatggcacagattttatcaagatgaagtgatagtaagaaaagctagaaaactcaccgcttgagtggttatccggagtgaagcgcaaggaagatggataaaacgcaaaaaataaacccacttttatcaggttgctggtaaaggtgggtttatcagtggtctgggctgaatatcactattcagttttttatatcatttccgcttactgtgttggttgtaatgtgctattcagtatgcttctagatgtttcaggagcaatttaactgccctttttactagagctaccataatccccgcacaaaagaacactggctctaatttatctcaaaacagttaaatttaagctaaaaaaccataaaaatggctttaattttgttttttttaggctataatttcaaaaaattatgtttctttataaggatttttgtaaatttatggctaatgtgataaatgaaatgtttattgatgtagtaaatgacgctcttactgggaaaaaagatagtcttttgatgagattgaaagtaatagctaaaaagctaaagaaagaactacctgacttagcaaaagaattggaatctttaatttccacttcaagcactaatgctgtcgcaagagggcaatcattaacacctcaattttctcctgttgatgccgataccagacaaaaattactaattgacgtatatccggtaattatggatacagttcctatatggtcagaaaaagtaaatactcagttaaatcgctttatagctgagtgggaaatgaaagaatccttacataaaggcgggctacatccatctacatctctgctcataagtggtccgccaggagtaggtaagacattatctgccaaatggattgctcataaacttgacatacccctcctaactttagatctcgccagtgtaatgagtagttacctaggtaaaaccggcaataatattaaagccgtactcaattatgcttcatcttttccatgtgtattattacttgatgagtttgattcaatagctaaaaagagagacgatacaactgatgtcggtgaattaaaaagattagtaaccgttattctccaagctattgacgaatggcctaagcaatctgtcttgatagcagcaactaatcattcagagcttctagatcctgctgtttggcgacggtttgacagtattattgattttgagcttccaaatcaagagctaattaaaaagtatctgatatctaaagatattagtaataatctgtcaaattatatatcaactaaattacatgatgtttcttatgccataatagaaagagccatcaatcaagctaaaaaaaattctatcatagaaaaaagacctttcagtgcaacattaattaatgaattattaggtgataatgttttactggaaaatgttattgaaacgatgttatcaacaaatatttctcaacgaaaaattgcacaagacttaggaatttcaagatctcaaatacaaaaatttgtgaaagaacaaggattacaacaatgaataataaaaatatgcttcttggttatggagaaacgcttactagcccagtaaaattgaatacaggcggaggacctaaaaataagccgtatacatatgaagaaaacaaacctgttattgtagcgcagctaaataaagtcatttctgaaattaacgacacactaccgcttgcaatgccagagggaaaagcagtagtaaaattcgttcttcatccagcttttttagctaaaagttattttccagttaagctattaaataaattttctcttcaaagtataggcagtaaggctgttagtattaaacctagaaaagatatcaaaaagagagggaagagagaagaatatacaaccgcctgtatttatgtgtccggtaaaaaagaaaattttcaggactttcttgatacattaaatgaagacaacctaaatcaaagcttaaaagatgattttattacgttagaaaatatatctacattaactacctcagataaaataaaaagttttaataatgatgaggttgtagctgttgaaatagctttacatacacccaataccccttcagggattgttgatgcttttgaggtatttgcaaaacaaaatggtgttttcgtagataaaaaaagaagcataagcgtaaaaggattaacattcatacctgctaaagccagtaaaaatatggcattgaaactcgcagaattctcttttctccggaacttaagagaattgccccaattacgggttaatgatcctgtgatattacgttcatctaccaatgactccactcttagccttccttcagaaggagctataaatcctgatttaaaagtcgcaatattcgatggaggactaggaattaataattttgatccttgggttaaagaatatatatggagtaatggtaataccagtgcgcaattactttctcatgggcaagatgttacatccactgttctttttggtgttgtgaataatgatactaaaaagcttagcgtaccttattgtaatatagatcattatagagtgttagattcggatattaataatactgatatagatttatttgatgttcttatccgtataaaaacagtattagaacaaacaaaatatgattacataaacctaagtttaggtccaagactcccgattgatgacgatgatgttcatgtatggacttcgacccttgaagaaattcttgctaaaagcggagctctttgcaccgtcgctgttggcaatgacggacatttgccagaatcactgaaccgaattcaaccgccttcagatttagttaatggattatctgttggtgcggcaacttctctatcagatgattggaaaagatgtttatatagctgcattggccctggaagaagccccgggtatataaaaccagatggtgttgcttttggaggatacactgaagaaccatttcaaacatatagtccgatgactaacggaattgtaagcactgccggaactagttttgctgccccgttagtattacggcaggcaatagccttaagtacatccttacaatataacatcacgccgttaacagctaaagctcttctcgtacaccatgcagaacctaaagattttccgcgtcatgaaattggatggggacgttttcctaatgatattaatgacattatctattgtagtgatgatgaagtaaaagttatttatcaaggaatactcaaaccatcacaatatatgagggtcttaattccaattccaaacatacctatacgaggaagtgtaacattaagggcaacattctgtttctcaacgtcagtggatccagaacattcccttaattatacaagaagtggacttgaagttattatgcgaaaaagtactgacgatactccaggacttacatttccattttttaatcagaaacgtatttatatggatgaaagtgaacaacgcgatgcccataaatgggaaaatacaataagaagtgaacacaaattcaaggctaacgagctaacaaccccatgttttgacataatttattatggaagagattgtggtatgcctgttgttcatataaatgaactggaagacttaccttacgttttggttgtaacattatctgcagaggaaatgcctgagctatataacctgataagacagagataccaaacactccaaccaattcaggtacagcaacaaattgtattacaacacacttaatattttagtacaataaaatatacatgataaaaatctgaatatcattgttcagctcagaccgctggcaaatctttaaagcaatgtgagcaatctttaggggcagcggtctgatagcggagaataccgctattttcttatgttccaatctcttttaacttccatctgttcttcgggttttgactacgccctacaatagaatgcttttcgataatcccctgactatgtaatcgtcttaatgcatgagaaaatgcaataacaactgactggaaatccgatttatcaggcgtatagccttccaattcaaaagccttaatcacaatctcatttgttgataaccactgatttggaaaatgcttaaaaactttagcaataaattcattcgggcgataagtgtaagctctagatttctcaccacgttgttttgtcgctaatgaaaatggctcactgtttaacgctatcaaggcttgctgtaacgtagcaatatgctgtttagccacctcaatacatctttcgaaataggtaacgtcttgtgttaatttagcgattttctgctgaatagcactcatacttacttgcttttatcatacataaaaatccttgtggttagtaaaactcacaaggattgtagtaaaatttagttaagtagtctttgtgcaactgctacataataccgcatttgttgcgtattatttgcttggtataaaacatcaccaaagtatggaatccttattaaaaaatactgaaaatggatttatggctattggtaatattttactgattataggtgccggaggggcatttaacagtattttaaaggcgagcggattaagtgatggattggctgagattttagcaaattttaatacacatcctattctattggcatggcttgttgctattgttttacatgccgcagtgggttctgcaacggtagcaatgatgggagcaacggcaatcgtgtcgccattacttgttacttaccctgatattagccccgaaattattgtccttgctattggttctggtgcgataggatgcactattgtaacggattctctcttttggttggtcaagcaatattgcggtgcaaccttgaatgacatttttaaatattataccggtgcaactttcatcgcttccgtattagcactcgggtttacatttttattatcaacagtgatttagaggtatcattatgaaaattcaacatttaatgcaagatcctttcattcaaaaattaatgcgttttgaagaagtgatgtggtttaatcctaaaagtgcgggggtaaaaacaggattgtcttacgttgggttggatgtatccgatactcaacaggcggcggaacgtttgcagcgttttgctccttatttttgtcgtgcttttcctgaaactcaaaaaacgaaaggtattttggaatctgaactggtatctattgataagatgaaatcggccttaatcgatcattatcatatgccgatacaaggacgtttattgctcaaaaaagacagtcatttaccaatttcagggtcaattaaagcaagaggcggaatatacgaagtgttggcttacgcagaaaaattggcattagaacaccatttaattaccgaaaatgatgattatagtcaattgtgcgatgaaaagatcaaagattttttcagccgttatagtattgcagtaggatcaacagggaatttggggctttccatcggtattatgggggctgtactcggcttcaaagttagtgtgcatatgtcagccgatgcaagagaatggaaaaagcaaaagttgcgttcatacggtgtgaatgttgtggaatatacacaagattacggtgtagctgtcgctcaaggacggaaggcagctctttccgatcctaactgcttttttattgatgatgagaattcgacaacactttttttaggttattccgttgcaggtcaacgactaaaacaacaatttttggaacaaggtataaaagtagatgaaaatcatccgctctttgtttatcttccttgtggtgttggcggtggacctggcggtgttgcattcggattgaaattggcatttggcgattatgtacactgcatttttgctgaaccgactcattcaccttgtatgcttctcggtgtttatacagggttacatgataaaattgctgtacaagacttgggtattgataatatcacagctgctgatggtttagcagtagggcgtgcatcaggatttgttggtcgggcaatggaacatttgttagacggtttttatactattgaagatcaaaagttatatgatttactggggctattgcataagacagaaaatattcaacttgagccttctggtttggcaggaatgataggtccgttgcatatcaatcactccgattatttaagaagatatcacatcacacaagaacaattggcaaatgcaacacatatagtgtgggcgactggtggtggaatggtgcctgatgttgagatgcaaaaatatttgtcactcgggcgattttaaaatattctccccaagttggtttttggggagaagaaagagtgcaagtgcggtagatttttagagagtactggaaataaataataaatttgatgcgtcactattttgtttatttttaagtgcattctgatttatttgcaaacatattgcctgttaaacaagcaaacaattaagattttgtgattttttaaaaattattgttgacttaaataagaaaaaaacgtttaatacgcaccactgacttgttgcctcgatagctcagtcggtagagcaggggattgaaaatccccgtgtcggtggttcgattccgcctcgaggcaccattctactcctccttagttcagtcggtagaacggtggactgttaatccatatgtcgctggttcaagtccagcaggaggagccaactctatgttagttatgttatagaacgatgccttattgattattgttttgttaagagggtgtcaaatagaaagtcaagaatttatctcaaaaatagattttcccaatttaaatttaattcattttaatagtatcaatcattcatattaaacttaatgtcttcgggacatggtaattccgcctttcagtgttccctatgctagtatatgcatcaacaagcacaagttatattgcttataatatagaaatagtgcatttgcaatgcttgcagaatcaatgttggtgaggtgtgaaaaaatgggtaatgatgaaggtatatttttttcaaagaaaattaaaaaaattaaacgttaaataatgcttaataataaaacaaaagtgcttttcttttgttaatttggtaaagtatatacatcaaaattcaaattaattagttaaaaattaagaaaaatgatatgtatacatcaaatttcactaatttaatcttaaatgtagacagctataaagcctcgcattggttgcaatatcccaaaggaacagaatatatttcctattatattgaagctcgtcgagaaagttttgatgtagtgatgttcggtttacaggcctttatcaaagaatatttgcttaaacctatttgccaacaagatgttgatgaagcagaaattgtattaaaagcacacggattgcctttttatagagatggttggcaacatctaatacataaacatcaaggttatttacccttaaaaattgaagctgtatcagaaggaacggtcttacctgttggtaacgtggtttgtcaaataaccaatacagatcctgattttttttggttagtcggctatttagaaaccgcacttttaagggcaatctggtatccttccactgttgcaagtctttcctatttttgtaaaaagcaaattagacaagctttaataaagtctgcagatgatctgtccggtttagactttcaattacatgattttggtgcacgaggtgcatcaagccttgaaactgttgcgttggggggattagctcatttagttaatttcaaaggaacagacagtgtttctgccttaattgctgcaaaacgctggtataacattaatgaaatgcctgcattttctattcctgctgccgaacatagcacgatcacttcttggggtaaagatcgggaaataaatgcttaccaaaatatgattgaatgctttggtggagagggaaaactttattccgtagtatcggatagttatgatctttggcatgccctggaacatatttggggcgagaaattaaaagatttggtgatcgaaaaaggcggaagattgattattcgacctgacagtggcaatcctatagagattatttgcaaaaccctagaaattttagcaaataaatttggttatattcttaatcaaaaaggctacaaagttttacctgattgtcttcgcattatccaaggagacggcatcaatgctcaaagtctaccaaaaattcttgatgctgttatgcaaaaaggatttagtgccgagaatgttaatttcggcatggggggaggactgctgcaacaagtcaatcgtgataccatgagttgggcaatgaaagctagtgccatttgtattaatggacagtggcaagagatttataaggatcccattaccagtcaaagtaagcgttctaaaaaaggtgttttggctttagtcaaacagggaagtgattggttaacaattaaacaatctgagttaaatggacaaactaatcagttacaaaccgtttttttcaatggaaaactttttatcgaagaaaacttaacggaaatccgcttgcggaccacgtcctttttagtatgaccatattttatacagtgagaaaaagatgatatttgaaaaagtatcatcttttatttttcgcttaacaatgtacttactattttctagctagtggcggtacaaatgtaattcccatatcccaaggctgttcaatccacgtattttgtggaatgtcaataacataatcatcaactaaattagcccccgctggtttggcaaaaacagtaacaaaacgcgcatttgggtagagttcacgaattgctcgagcagtatttcccgtatcaactaaatcatcaactacaataaaaccttcgccaccattttttacctgtgctgcatgcaaaacatttaaattgccttgctgattatggtcataacttgaaatacaaacagtttcaatatgacgaataccaagttcacgagcaataactgcagctggaaataatccaccacgactaacggcaataatacctttccattgtgttgccggaagcaaacgttctgataatttacgtgtatgcatttggaacatgtcccaagttacaacatatttttcgctcataattcaccctaaagtcagttgatagcggagttccgcctgagaaataaaatggcgttagaataacctgaaatctatttttatgctattattttccttatttttcgctaataaaggataaaaaaatatgtcagatcttcaatctctgcaacctaaactactttggcaatggtttgatcaaatttgtgctattccacatccttcttacaaagaagagcagttagcacaattcattattaattgggcaaaaacaaaaggtttttttgcggaacgtgatgaagtcggtaatgtattaattcgtaaaccggcaacagtaggaatggaaaatcgtaaacctgtagtactacaagcacacttagatatggttccacaagctaatgaagggacaaatcataattttgatcaggatcctattttgccatatatcgatggtgattgggttaaggctaaaggtacaacgttaggtgctgataacggtatcggtatggcatctgcacttgctgttttagaaagtaatgatattgcacatccggagttggaagtattgttaaccatgactgaagaaagggggatggagggggcgattgggctacgtccaaattggcttcgttctgagatcttaattaataccgatactgaagaaaatggagaaatttatataggttgtgccggcggtgaaaatgcagatcttgaattacctattgagtatcaagtcaataatttcgaacattgctatcaagttgtgttaaaagggttacgaggtgggcattctggtgtggatattcataccggacgagctaatgcaatcaaagtgttgcttcgttttttagcagaacttcaacaaaaccaaccgcactttgacttcactttagcaaatatccgtggcggttctattcgcaatgctattccaagagaaagtgttgccactttggtctttaatggtgatattaccgtattacaaagtgcggtacaaaaatttgcagatgtaatcaaagccgaattggcactaactgagccaaacttgatatttacacttgaaaaagttgaaaaacctcaacaagtattttccagtcaatgcacgaaaaatattatccattgtttgaatgttttgccaaatggcgtagtacgtaacagtgatgtcattgaaaatgtggtagaaacatcattaagcattggcgtgttaaaaactgaagataattttgttagaagtaccatgttagtgcggtcattaattgaaagtggcaaatcctatgttgcttctttattaaaatctttagcctcattagcacaaggtaatatcaatttatcaggcgattatccgggttgggaaccacaaagtcatagtgatattttggacttaactaagacaatttatgcacaagttttaggtacagatcctgaaatcaaggtaattcatgcgggacttgagtgtgggttattgaaaaaaatctatccaacgatcgatatggtatctatcggaccaacaattagaaatgcacattctccggatgaaaaagtacatattccggctgtggaaacttattggaaagtattaaccggtatacttgctcatattccatcacgttaaaaattgatatacaagacaagtataaagagcggtgtaaatttgcaaagaattgagcaagcccattagataactttctcattcttaaaactaaaaatccttgtagaaaattgttttttacaaggatttttgtatcgaacaacaatctgtttaattcaacattttctttaactgatataaacactcaagtgcttgcttcggacttaactcattaggatcaagcgtttttagcgtttcaatcaccgcacttgtattctcctcctcttccattaaagttaattccccttgaacttgtgtcaaaacggactgtgattggtaactgttttgctgagaaagtgtttcaagctgttttaatttctgttttgccgatttaattacattttgtgggacaccggctaaagcagcaacagccaaaccataacttttacttgccgcaccttcctgtaccgaatgcataaaggcaatactgtcgttatgctcaaaagcatcaagatgaacattatggataccgtcgattttttctggtaaaaccgtcagttcaaagtaatgagtagcaaataaagttaaactacgaattttttgagccaattgttcagcacaagcccaagcaagagaaagtccatcataggttgacgttcctcgcccaatttcatcaataagcaccaaactttgctccgtcgcttgatgcaaaatatttgccatttcagtcatttcaaccataaaagttgaacgtccggaagcaagatcgtcagaagcaccaatacgtgtaaaaattcgatcaataggtccgattaccgcactttctgcaggtacaaaactaccaatatatgccattaaagtaatcaatgctgtttgtcgcatataagtacttttaccccccatattcggtcccgtaataatcaacaaatgacgcttttgattaagttctacgggattagcaataaagggatcttttaatacttgctctacaaccggatgacgcccctgcattatttgcaaaccgatttgcgtactaaattgtggttgaacataatttaaggtttccgcccgttccgccaaattggttaaaacatcaagctctgccaaagttaaactggctagttgtaaatcacctaagtgcggtaataattgatcgaaaatttcatcataaagttgtttttctaacgcaagtgacgctccttttgcttttagaactttttcttcataagtttttagctcaggaataatataacgttctacatttttcaatgtttggcgacgtacataatgaagcggtgctttatgtgcttgcccttgactgatttgaatataataaccatgcactgcattaaaaccgatttttaatgtatcaataccagtatttgcacgctcacgttgctccaaatcctttaagtagcgtgttgctccttcagacaaactccgccattcatcaagctcctcgttgtaaccttcagcaatgacaccgccatcacgaataagtaaggggggattatcaataatcgctcgctgcaaaagtgctaattgcacagaaaaatcagcaatttgttgtgaaaatgcaacaaagtgcggtatttttgttaattggtgttgaataaaaggtatttgttccaacgctgttcgtagccgagttaaatctcgaggtcgagcggaacgcagggcaacccgagcaagaatacgctccatatcgccaacttgacgtaaaagaggttgtaattcttcaactaaattttgctgcaacagcatttgaatatgttgttgacgatactgcaatttttcaatattgcgaataggctggtgaatccaacgtttaagtaagcgacttcccatcggggtaacacatttatctaaaattgcagcaagtgtattttcagttccgccagcaagattttgggttagttctaaatttctacgtgttgacgcatcaatttgtacagtatcgctattttgtaacaagctaatactttgaatatgaggaagtgcggtacgttgcgtttcttttgcatattgcaacaaacaacccgcagcacataatcctaaaaccgctttttctacaccaaaaccacgcaaatcttttgtaccgaattggcgattaagtaattgaattgccgtacttaattcaaactcccaaagaggacgacgacgtaatcctttgaattgttcaattaaatgtttatcctctaacgcttccgaatatagtaattcaaccggttgaatacgttgtaactccgcttgtaaactggcggcatcttgtagttcgctaatttgaaaacaccctgaagtcatatctaaaacagctaagccaaattgtgttttttcttgataaatcgtagcgataagattgtcttgtttttccggtaacaatgcttcatcactcactgttcccggtgtaacaatacgtacgacttggcgttcaaccggacctttagctataacaggctcaccaacttgctcacaaattgctacactttccccaagttgtaccaattttgctaaatatccttctattgcatgataaggtacgccagccattggaaccggttgtccagctgattgccctcttttagttagggaaatatctaataattcagcagctttttttgcatcatcataaaaaagctcataaaaatcacccatgcgataaaacaacaaaacatccggattttccgcttttatttttaaatattgtttcatcattggcgtgtgattttcgaatgtgtgcatggctttcattgtgttaataagtaaaaagaatgagtggaattataacaaaagtgcggtctgttttgctggtgttttttgtatctgctttcaagtcaaaagaataaaaatatgtctaaatgatcaagcggttgctcctgccttttatatttttatctcgtttccactaaataaagggtcaatttccggcattacgccacgccataaataaaatgcgtgagcagcttgcccaaccagcataccgaagccatcgctaattttggttaccccttgttttttacacaatgcaataaaaggcgtgtcgctttctttgctgtattgcatatcataaacggcagaggcaagttgtaaaatctgaggatcaatatcaatagttttaccttgtaatcctgttgatgtagcattgatgattaaatcaaatgtttgtatcggaatatgttccagatccaacgcttcaatggtgccaaaatgattgaatttatgtgctaagtcttcagctctactaaaagtgcggttggtaattaagatattttgttgagcttgtaataaaggcaataaaactccttttgtggcaccgcctgcgcctaaaatcagtattctttggtttggtttgagccaatttaaacgttgtaaatcgctcactaaaccggcaccatccgtattatcagcaaataatgttccatcagctaatttttttaaggtgttacaagactccgcacttaaacaacgcttgctatgttgttgtgccaatttaaatgctcgctctttgaaaggagcggtaatattgcagcctttagcaccttgtgcaaaaaaatcgctcaactgttgttcaaatttttcttcatcacccaatatcgctacataatctaagttttgtcgagtctgcttcgcaaaatatcgatgaagttgaggagatctactttgagcaatgggatttccccaaactgcgtatttatccattttttatccttgtctaactaattgattagtaaataaatcacgaatttcagatggttttgtggctgagccaactgacatatccaatacaggaaaatccgccccgaattgtaacctgacttcatcgctggttttgcaaggtgcaatcccacttaaattggcactggtagaagttaaagcaaaacctgtttgttcgcaaagtattttgatggcgggatgttggcttactcgaatagctatactattaaaattgccacataagaatttagcaatatctttttttgccggcacaatccatgtaatggggcgaggataagtttgttgtagtttttgccaatgttgagaattgatctgttccttatcaataaaagaaaaaaaataatctaatttgggtgcaactaaaattaaacctttttctcttgggcgttgctttaaaattaataatttttctaccgcactttgactaaaagggttgcaacctaaaccgaaaacagcctctgtcggataggcgacgacttcattttgtttcaatttttcaataatttgtgtgatattcatattgttgttttgaaaatatgttgacaatttttattgatacacaaccaagtgcggtgattttcgtctttttttttcaagattgcaccttgcatttggcaatgggggcaagggattaaatgaggtttttgtgctaaggtaaatttgcatttcgggtactgattacaagcataaaaattttttccttgccgtccatgtcgagcaacaatttcaccatgttgacattccggacaaacaatctgttgttctgtcgtttcttgttcttcatgcacgacaaaacgacattccggataaccgctacaaccgataaacatgccgtaactaccctgttttagttgtaaaaaacgaccgcacttcggacaattttgagcaagatttttaagtattttactttcattattagggtgtaaaggcttgatataatcgcaagatggatagttagaacaacccaaaaacaaccctttttttccttgtttcatctgcaaaacagcttcacattgaggacaatgttcttgatgtttggtatgttggaaaaggctttttgacatattcttttttcaatccttgtgagaaaaaacaacaataaacgatcctatcaataatatcaacttacaatcctaatttgaaagccattctagcacagtgtagaatgtgcaacattgtatttaggataagagttttatgaatttacaagatcattttttgattgccatgcctcatttagaggacgagaattttcagcgttccgttgtgtatatttgtgaaaataatgaacaaggctcaatgggattagtgctaactcaagcaacagatttaagcattgctgaattatgtgcaaaaatgaattttatgatggcggatgagcgtgaatattccgataaattagttttattaggtgggcctgtaaatttagagcatggttttattttacataagaaaacagcccaagaatttcagcatagctataaagttacagatcaaatttatcttacaacttcggcggatataattaatacttttggtaccgcacaatcaccggaaaaatatttggttactctggggtgtgcaagatgggagccgaatcaactggaaaatgaaatagccaataatgattggttggttgtgcctgccaatgaaaatattttatttgatgtgaacagttcggaacgttggtttgccgctaatcaattattaggtattgagcatgtaaatttttcgtatcaacaacaaatggaacatagttaatgtcaattacagttttagcctttgattttggcacaaaaagtatcggttgtgctgtagggcaaagtataacaggtacggcacaagcactcccagcatttaaagcacaagacggtatacctgactggttaaaaattgaaaaatgtttgaaagactggcaacctaatattgttgttgtcgggttacctttaaatatggatggtagcgagcaagatctcactcatctagcgagaaaatttgctaatcgtttgaacggtcgatttggtgtgaaagttgaattacaagatgaacgcctaaccaccaaacaagcccgtgatgaaatattccaacgaggcggttaccgagccttaaagaaagaaaaagtagatagtatttctgcctgtttgattttagaaagttggtttgaaaatggtgcttgtggggaataattacactaaaattaactcaatttccatttcttttatcgattcttgggcatttagtaacagcttgtcatcgcaaataatgctattgaatacatttaattcacaaatagaaaatgtagctgtttttccatatttagaagaatcagataccaaaattttgttgtaactggattgcaatattgcttttttaacaggcagttttttctcatccggtgtagttaagcctcttaaattccaagatgatgtggaaataaatgccagatcaattgaaagctgtttcaataactgtgtagccaattcaccaacagaggagaaattagatttattaattgatcctcctgtatgaattaattcacattgtccatgtttcatcaagaaattagctatcacaaaatcatttgtaatcaccaacagatcttctcgttgagcaatattatgtgcgatttctaatgttgttgttccggcatctaagtagatagttgtatttaccggtattagctcagccgctcgactaccaattttttctttttgtagcgtggaaagcaaagatttgtcattgtgtgtcggttcaataaataaatgttctaataatttcacaccgccggaaactgaaacaacaataccttcttgctctaatttttgaatatctcgacgaacagtcatgtgagatacacctaataattttactaattcattgatactaataatctcttgcttactaatcagcttaagaagttttttttgtctttctgccggtatcattttttactcctgattttttacataattatatcactttttccatttaggctaatatctataaaattaacattatttaacaaataatgttaaatagtgtgatcatgatctcattttttttgtaaaaaaaagtgcaaaatacaccatcaaataactttaaaggagtgatcagtatgaaccaaaaactattttctgtcgctgttattggtttaggtgcaatggggatgggagctgcaaaatcatgcattcaagcaggattagatacctatggcgttgatttaaatttacaagccttagagattttaaaaacagctggagcaaaacaagtgagtacaagtgcgataggttttgcaaaagatttagatgctgttttgctattagtcgtcaatgcaaatcaagtaaataatattttatttggggaacaaggattggcacagcatttaaaacctaaaactgcggtaatgatttcatccactatttctgcacaagatgccaaagaaatttcacaaaaattaacaaaacttgatttgataatgttagatgcacctgtatcaggtggagctgcaaaagccgctcaaggtgaaatgacggtaatggcatccggatctacagaagcttttgagaaattaaaaccggttttagacgcagtttcaggcaaagtgtataacatcggagaagagattggtttgggtgcaaccgtaaaaattattcatcaattactggcgggagtgcatattgctgcaggggcggaagcgatggcattagccgcaaaagcaggtattccacttgatttgatgtacgatgtagtaactaatgcagcgggcaattcatggatgtttgaaaaccgaatgaaacatgtggtagatggcgactatacgcctctctccatggtcgatatttttgtaaaagatctcggtttagtgaatgacacggcaaaatctttacattttccacttcatttagctagcacggcttattcaatgtttactgaggctagtaatgcaggctacggtaaagaagacgatagtgcggtaatcaaaattttcagtggtcttgatctaccgaaaaaaggaggacactaatatgttaggtgtcatagcagatgattttaccggtgcaagcgatattgcgagttttttagtcgaaaatggcttaaaaacagtgcagatgaacggtataccaaaaatcgcacttaacagcaaagttgatgcaattgtaattagcttgaaatcacgttccaatcctgttgaggaagctatccaacaatcgttacaagccttagattggctaaaacaaaatggctgtacccaattctatttcaaatattgctcaactttcgatagtactgaaaaaggcaatatcggaccggtaacggatgcgttaatggctgcattagaaactgattttactgtcattacccccgcacttcctgttaatgggagaactatctttaatggttatttgtttgtaggtgatgtattgctgaatgaatccggtatgcgtaatcatccgattacaccgatgaaagaggctaatttagttcgcttaatggacgcacagtctcaaggtaaaactgggttattgacttatgcagatgttattcaaggtgcagagcgtgtgaaagcacgttttacagaattaaaacaacagggctataaatatgcagtagtggatgcggtagataattcacagcttgcggtacttgctgaagccgtggcggattttaaattggttaccggcggctcaggtttgggggcttacatagcagcgtatcgctcaggcggtcagaaaggaacgaatgcttttgtaccgaataaaggcaaaacggttgtactttcaggatcttgttctgtgatgacaaacagccaagtcaatgcgtataaagcccaagcaccaagttatttcttgcaagccgagcaagccattaacaatccaaattatgtggaagaactttatgcgtgggttgttgaaaatctaaatggcaactttgcaccgatggtttatgccactgtaccgcctgaaaaattgaaagaaatccaacaccagtttggtggggataaagcaagccatgcgattgaaactacatttgcaaaacttgcaaaaaaattgaaagttgcaggggtaactaacttcatcactgcaggcggtgaaacatcgagcattgtagtccagcagcttgctttctctgggtttcacatcggcaagcaaattgcacccggtgtgccatggctacaagcagtcgaagagccgatttttcttgccttaaaatctggtaacttcggtaaagagaatttctttagttttgcacaaggaatgtgtgtatgacagaacttgaacaaaaacaacaaatggttgctttagctcgttcattatttgagcggggatatacagtaggtggtgcaggcaatctatccgtgcgtttagataaaaaccgtattttagttacgccaacaggttcttcactcggacgtttagaagcagatcgactttctgtgttagatatgcaaggaaatgtgctttctggtgataaaccgtccaaagaatctgttttccacttagcgatgtatcagaaaaatccgagttgccaagcgattgtacatctacattctacttatttaaccgcactttcttgtttggaagatttagatacagaaaatgcaatacgagccttcaccccttactacgtgatgcgtatcggcaaattacctgtaattccttactatcgcccgggcaacttcaatattgccaaagaattaggcgagagagctttagatggcaaggcttttctgcttgcgaatcacggagtggtagttacaggagaaagcctaatagatgctgtagataatactgaagaattggaagaaaccgccaaactctattttattttacaaggtcaaaaagtgcggtatttaaccgatgatgaagtcaatgacctgaaacacagaggaaaataaatatgcccaaatttgctgcaaatttaaccatgatgtttaacgaagtcccttttttagaccgatttgaagcagctgctactgccggttttaaatatgtggaatacctttggccctatgattatccagcagatatgctaaaggaaaaattagataagtatggtttacaacaagttctatttaatacttcagcaggcaatgtagacgccggcgaatggggtgtctctgcgattccggggcgtgaagcggatagtcaccgtgacatcgatcttgctcttgaatatgctcttgccttaggttgttcacacgttcatgtgatggcggcagttgtaccgcaaggcgaagatcgagaagcctataaacagactttcatcaaaaatgtgcaatatgcggcagataaatttaaaccgcacggtattaaagtcttgttagaagcactcagcccggaagtcaaacctaactacctgctgaaaagtcaattcgacacgctagaaattgttgaatccgtcaaccgagataacgtctttgtacagttggattatttccacgcacaaaatgtagatggcaacttgtctcgcttaaccgacaaactcaacggcaaatttgcccatatccaaattgcctccgtgccgaatcgccatgagcctgatgaaggtgaaataaattaccaatatctctttgataaattggatcaaattggctatcaaggttttattggctgtgaatataaaccacgctctgacaccttagcaggtttagattggtttaaaccttatcaacaaaaataaaataggtgctctttatgaattatcagttactttcttatcctctagatgtaaaagatcctggttttccaaatgaacccactctaacttatgatatttgtacaagtactgcacagggagatgtgtataacagtgctatgattcacttgtttaatcatttcgggacacattttgatgcacctaagcattttaatccacatggtttatctattactgaattacctttaatgtatttcatttatgaaaaacccctgttaattgatttgcctaaacctgtcggttcgctaatcgaacctgaggatttatccccttttttaactcatataaaacaggctgattgtttattaattcgtactggcttagaacacttaagatctgaaaatccacaacaatatgctgaaaatggtgttgccgtaagcattcaggctgcaaaatttttgattgattatgccagtaatttaaaagctattggatttgattttatttctcttgcttcaccagcgaatcctgatcatggcatcgaagctcatcaagtaatgttaggaatgtataaagaaaaatttatttgcattattgaagatatgaaattatcgaagcttaataaaaaaacattaaaacgtgttttagctatgcctttacttgttaaaggaattgatagtgcacaagttactgtgttagcagaaggattttagtatgaactcaatgaaaaattatttttggggatgtgtatttttattatttactttcctaagtgcttatcttgcttctttatatgatcgtgattttggacgaattgaagtcagttcagtaagttttatgacagaagaaatgcaacctatggtagctaaactttatcgtcctgtttccgcaaccgcagaaacaccaaaacctggattacttgcattacatggttatcaaagcgataaagaagcaacaagtacttttggtgctttagaattagcaaagcgtggttttgtcgtattggctatagaccattttggacatggctattcaacaaaattacctgcatcaaataagaacatgagtggagcaaataatggttatcaatatttgaaaactttacctttcgttgataaatcacgtttaggtatttttggacattccactggtgcattaaatgcaattcgtgttgcaaaactcaatcctgatcataaggctgtcaatggattaagtagtaatggcggtgacatggaactgaataactacttattaactcaaggcttatatgaagagataggcggatatcgtgaaaaaacattccctgttaaaaatttagttattcaccccaaccgcttaattgcttttggtttacctgaaaacgaatctttagaatgggatcatacctatggtagttttaaggatggttctgcacgccgtgctgctatagttgatggtacacaccttggtgtaatgattgcttctaatagtaataaagaagctatcctttggtttaatcaagcactacaagatggagaaaaaggggttgattggatagaagcagatcaacaaacatattggtataaggaattttcaggcttgtttgctttgggttcagctttaattgctacattattttttgcaaacggtttgttaaatagtgcttatttttctgttgtatgtaaaccggtaagcgagaaaactgcagttactgataaacaatggtggaagtttacaacagtcaatattgtattaactatgttactttatccattatttactcaatggggtggtgctaatgaacctattgcatctaaactgagttttatgccattagaaatgggtaatggcattattctttggttagtggtaagtagtatcattggaatcattttatttagtttatggaaaagaaaagttgctgtttcgctggcagaatttggtgtgactagccattcttcagtattaacgacaagtcaaattattgtgcgttatttacttctaagtatcctattaattttaggattgtatctactcacaagtttaatttatcaagcttttagtgttgaattacgctttctatggcctctattaaaaccattaacagctgaacgttttagtttattttttgtttattggttaccaattttagtgtttttcttcatttttaatggattaattgtttccgtgcaaatgaaacaaaaattggctacatcttttagctcaactctcattatttggagcataaaaacaaccatttttaccacatttggattagttatattgtggttattccattttgtccctaattttatgcaaataggtccagggtttgatttacttgggttaccacaattcggtggacgttggatgatgatgttagctgtgattattcctcaatttattgtatttactgtgatcaatcactggtgctatttgaaaacgggatacatttatttaggagtatttttcacctctctattaatgacttggattttagtaggtggtcaagtaatcggtcggttcctcgcataaaaattaattacttagaaaatttttaacgaagtagtaaaaagccctatttttcaagggtagggctttttacaccctgcaaacccaaaattgcattaaaaacaagcagtttttgtttaaagtgcaatctattttaaggagaacacaatgaaaattgttattacaggaggacaaggttttttaggacagcgtcttgcaaagactttgttatccaattcaactttatcaatcaatgaattagtgttgattgatgtcattaaacccattgctccaaacaatgatccacgtgtgcgttgtttggaaatggatttgagaaatcctgaaggtttagatgaaattattaccgaaaaaacaaccgctctttttcacttggctgcaattgtgagtagtcatgcagagcaagatcctgacttaggctatgaaatcaatttcttagcaactcgcaatttattagaggtttgtcgaaaaaataatcctaaagtgcggtttattttttcaagttctttagcggtgtatggtggtaatttacctgaaattattcaagatcacaccgcagttacaccacaatctacttatggttctcaaaaagcaatgtgtgagttattgatcaatgattattcacgcaaaggctttgttgacggcattgtagttcgattaccaaccatttgtattcgtccaggaaaaccgaataaagcagcctcttcttttgtaagtagcattattcgtgagcctttacagggtgaagaagccatttgtccggtttcgtcagatttacgcctatggctttccagtccaaataccgtaattaataattttattcatgcgttaactttgccatcgctaccacagcgtagttggcacattattaacttaccgggctttacggttagcgtaaaacaaatgttatctgatttagcttcaataaaaggtgaaaacatcttagaaaaagtgcgatttgaatttgatgaaaatatcaacaatatcgtcgcaagttggccggcagagattgataataaaactgctcttaaacatggctttaatgtggatgctgatttcaaagaagttattcaacaatttattaaaaacgatatgtaacttaggagcaacagtatgtttgacttaccaattccaatcattggactattgattgcggtatttgtcttagtctatttagtgttaaaaacacgtgttcatgcatttattgctatgctgattgcttctgcgattgccggccttgttggcgggatgtccgtcaatgaaactctcggtgccattagtaaggggtttggtggaaccttaggcggtattggtattgttatcggtttaggggttatgatgggaagcgtgcttgaagtttcaggggcggcagaaaaaatggcttacagcttcatcaaactgctcggtaagaaaaaagaagagtgggctttggcaattactggttatattgtaagcattcccattttcgttgattcagctttcgttattctttatccagtggctaaagcattggcaaaaaacggaaaacgttctcttttaaccttaggcgttgcacttgctggtggcttagtggtaactcaccatactgttccaccaacacccggtcctttaggtgtggcaggattatttgctgttgatattggtgctatgttgttagtagggatggctctcgctatattgccggttattggtattgttctttacgcaaaatggctagataaaaaatatccggaatttaaccaacaagttttcactcaagaagaattgaaacaaaaatacgatgactatattgaaagtcgtgagaaaaagaatttaccaagcttagggttatccttactgccaattgttttgccaatcgttctgatctttatcaaagcaatgtttgatttaactgcaaaaggtcatgcggaactggctcaaatgggagtttatcaattctttgcttttgttggtcatccaatgattgcattagcaatcagcgtattagttgctgtttataccttattaccaaaagcagaccgtgattcgaccgcacttcatctcgaagaaggagtcaaaactgcgggaattattttattggtaaccggagccggtggtgcattaggtgctgtgctacgtgacagcggtgcaggtaaacaactagcggaacaaattgcttcattgccaatttcaccaattcttattccgtttattgtttcaacccttgttcgctttattcaaggttccggtacagttgcaatggtaacggcagcctcaatatccgcccctattttggctcaaattccaggtgtgaatatgttgttagcagcacaagcagccacaatgggttcattattcttcggttactttaacgatagcttattctgggttgtgaaccgtatgatgggcatcaatgatgtgaagaaacaaatgatagtttggtctgtgccaaccacgattgcgtgggggattgggggtatcagtgtgattctctgtaaccttgtctggggtaacgatggctcattatttgatcttttgttccctattgctgtaatggcaattattgcattctacatcaagttccaaaatagaactttgaataaataatcaacgcgcaaatagactatgaatgttattcgtagtctattttttaatctaaatgaggagtgaatatgaaaaaatattttattttggctagtggtttgctgttgtccactttggcctgtgcaatacctgatgaaattaaacctaattccaatgtgaatataactttgctcgcagaagtaaccgcacaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtctattttttaatctaaatgaggagtgaatatgaaaaaatattnnagcaccagtattgcattattacaacaataagtatattcaagtgaaagtgtgtcctatgaaatacagaacgcagttcttgaattaaattaggttaacttaaaaacggtataaacctatgtaatcagttatcatattaaagatattagctcgttgggtttattccaaaccaatgagctttttcacagtaaatttctttatgtagttttagattcctactataacggggtttacattgaatagatatccatcaaaattagtgtcctctacatcggataattcaagcaatttagttttaacattttctagatgttgccacattgctttacgtgccaaagcaggatttttgcgctgaatcgcatttaaaatcgtttcatgatctttaatccataagtgatggagatcattatgtatgatacgcgaatgaagctgtgtccacatagcattattaaaacgatatttccaaagttgctcttgagtttgaataaggacatcgtttccagtaatttcggcaagagcaagatggaattctttgtcagcactgcagtcatcaatattttgagcaaataattccttttctttatcaagaatttgcctaagtcgtaaaatatcttgtttggtaacctgttgtgcagcaaattcagcaatactgctttctaacaattgtcgtgcttgaagtagttcaaatgggcctacatctcttagcttattatctgcttcttcttgaagaagatctgggatttttatgacgtatattccggatccttttcttacttcaataatcttttccacttccaacattactatcgcttcccttacgatagttctacttacttcaaatctttcagaaatatttctctcggtaggtagcttatcgcctattttgtattttccttgagaaatttcctctttaagtatttttcctatttttgtgtaagttctagaattattttgcataaatcctcgcaatattggcacgccaaaataaatttatgtgatcagtatcacaattatagaaaattggaataccaaaaaatatactttgatgttactgtctgttcataaaatatcattgacgacattaaatgtcgattaactttgttaaagagggaaacattatgagcaaatacgtaagatcagtttgtctcgtggaacctaagaaggttgatataaagaccgtgttgtatcctaaaaaaggtgagtgtgatgttctgatcaaagtagagagtataggaatctgcggatctgatattggtgcatttagaggtacaaatccgctggtaacttaccctagaattttaggacatgaaattgttggtacagtcattgaatccggtgttggtatgccaaaaaatattaatataggtgatcgtgtaattctcgaaccttacatttattgtggacattgctatccttgttcaatcagtagaacaaattgctgtgaggcactaaaagttttgggggtacatattgatggagcaatgcaagaaattgttagacatccagctcatatgcttattaaagcacctgatataccgatacatgaactggctttagcagaacctttaactatttcattacatgcaattcgtagaaccaaagtaaaagccggagaacacgttgctatcatcggtgcaggtgcgattggactgatggctgcattagttgccaaagcttatggtgcgacaccaattttaattgacattttagacaagcgattagattacgcaaaatctattggcattccaaatataattaacccagcaaaagaaaatgatcttgaagctattaaatccattactaacggaagaatggctgaggttgttattgaagcgtcaggagcaaatattgctgtacaaaatacgcttaaatatacttcttttgcaggacgtattgctttaactggatggccgaaaaacgaaacgccactaccaactaatttaattaccttcaaagaacttaacatttatggagcaagaacaagcaagggggaatttgaagaagcattaaaacttttagaatccagaaagattgaaccgaagaatattattagtaaggtaattacatttgatgaaattcctcactacatcgaagagctttcagaaaatcctgatgattatttaaaaatcattgctgtattttaagtcttaactaacctatgaggtaataattatgaaactcaaaaaattaactaaagtattagttgttgcaggcttagtatttagtagttcggcatttgctaaaactgtaattaaaatcggacattttaattccgatatgcacccgtcaaatattgtattaaacgaagttttcaagaaaaccgttgaagaaaaaacgcaaggtcgctatgaaattcgtattttcccaaataatcaattgggcggcgaagatcaaatcgtaaatggcttacgcaatggtacgattgaaggtggaattaccggcttattgttacaaaatgtggatcctatttttggtgtgtgggaaatgccgtatttatttaaagacaatgttgaagcgaaaaaggtattggaatctccgattgcaaaagaaattggcgataaaatggaacaatacggtattaaattattggcttacggcatgaacggttttcgtgtgatttcgtccaataaaaaattggaaaaattcgatgatttcaaaggattacgtttaagagtgccattgaattccttgtttgtggattgggcaaaagcaatgaatattaacccgcaaagcatgccattaagtgaagtctttactgcattagagcaaaaagtgattgatggccaagaaaatccatatatgttgctcaaagattccggtttgtatgaagtacaaaaatacattatccaaactaaccatattttctcaccgggattattgcaattaagcttgaaaacttggaataaaatgtcaaaagaagatcaagaaattttcttagaagcggctaaattatatcaagagaaagaatgggaattagcgatgaagatggaacaagatgttaaagacttcttccataaaaacggtaaagaagtaattattccgtccgagcagtttaaagcagatatgttgaaagcctctgaaacactttatcaaaatttttatcaaaaatatgattgggcaaaaggcgtgattgaaaaaattcaagccgctaaataattgaaatcataggctgtttgttagcaaacagcctttttcctatcgctttttaggagataaaacaatgaaattttctaccacacttgaccgcactttaaagatgttggcagtgattgcattagtgacaatgattttattggtcttttttaatgccatgctacgttattttttcgattcaggtattgcttggtcggaagaatttgctcgaatttgtttcgtctatatgatttttttaggcattatcttagttgccaaagaaagagggcatttgactgttgatattgtgatttcttatttacctgcatacgtacagatgtatgccttattttttgctgatatattagtgttgcttgccttatcttttattacttatggtgcatatcaattaatgttgctgacttatacacaaaaaatgcccgcaacggaaatttctaccgcatttttatatttagcagctgtgatttcttccttatcttattttctcgtggtttttaccaatttatggaaacatttaaaactggcatttagaggagggaaagcatgatgttaggattatttttaggtagcttattcctatttttatttcttggtgtgccagtagcgttatcaatgttactgagtgccagttttatgttatggcatatggatatgtttgatactcaattaattgctgaaaactttgtaatgggtactaataactttcccttaatggcaattccattttttatgttgactggtgaaattatgaaatacggcggtatttctgagcggattatcaattttgctatgagtatggtaggacatattaaaggaggattaggttatgtagtgattatttcaggtttaatctttgctgggttatctggttctgctgtagcagacaccgcagcgttaggggcaattttaattccaatgatggtagctaaaaaatatgatgttgctcgttctacaggtttagtctgtgcggcaggaattatttcggtggtcattcctccaagtattccaatgattgtatatggaattaccgcaggtgcatccattaccaaattatttatgggtggcacggttcctggattattaatggttacaggattgtggttaatgtggaaatttttatatcgtaatcacgaagaaaatataaaaccgaaacaatctggtgcagaacgctggcaagcttttaaaaaagcttttttcccattattgttaccggtcattatcattgttgggttgcgtggcggtatttttactccaacagaagcaggtgtagttgcggcgatttatgcgggattggttagtcttggctatcgcagtttaaataaagaaaatttaatcgaagtctttttaaatacgattaaaactacttcaatggtgatgtttgttgcggctgcggcaatgatttctgcatttgcaatcactgttgctcaaattccaatggagttggtgcaatttatcaaaggattaactgacaattcaacggtattaatgttggttattatgattttcttattactcgttggttgtgtaatggatttaattcctgcagtattaatttttgtacccgtattattgccggtattgagagcttacaatatcgatattgcttattttggtattatgatggtgattaacttatcgattggcttaatcacacctccagtgggaacggtactttatgttggttcgggaattgctaaacttggcataagtaaaattagtaagggaatttcgccgtttttgttagtttatgttgctattttaatgttgatggtgttctttcctgatgttgtgattgtaccaatgaattggttatcttagtggtgcttattatatccattgttataaagacaaagttgtcgtaatgacagaagctggcaatatgaataaagcgatattttgtaataaaaataacgtataaatcgcaatttttacaaattgatttgacagaaaagatattcgggtgtaaaacattttttacatttcattaacattttggaacgttttatgctcaccattcatcatacgagtgaacaatcacttctctgtgaaattgctcctcctgctgaacttgccaagcaacagcgtatttggcaaattgcagagcaggctcggcaacttgccaatgtgcaagaagtagtggttggtatgaataattttactgtctattacgatttatttgcagatagtcaaccattaattgaaagcctgcaatcattgtgggaaaattatcaaccacaatcagttaaaacaccacgctgtattgagattccagtgcattatggtggcgagtttggtgaagatttatttgatgtagcacaatttcaccaaactacgccaaaagaaattattcgccgtcataccgaacctgtttacactgtgtttatgatcggttttcaagctggatttccttatctaaacgggttacctgaaagtcttcatacaccaagacgtgatatacctcgtactaaggtgcctgcaggctccgtcggcattggcggtagtcaaacaggaatttatccttttacctcaccgggtggctggcagttgctcgggcgtactgatttagcactatttgatattcaacaatctccaccaacactattaagtgcgggtgataatgtccgttttgttgcagagagtattcaactatgatctacattaaacaagtgcaaggttttgctcatattcaagatttaggtcgttatggctttcgttctctcggtattggacacagcggtgcaatggattctttggctttacaagcaggcaatttgttactaaaaaatgcaaataacgccccagcaatagaaattacgcttggtggaatgagtttgacatttgattgtgatactccattttgctttactggtgcattagtagaggctgaactggatggcatgcctgtattttcctactttcgttatactgccaaagtgcgtcaaactttaacgcttaaacgtattataaaaggtaattatacttatctttgcgttgccggcggttttcttgtaccacaggtgcaaggctcagccagtactgatctcagggctcaatttggtggttatcagggacgaatgttaaaagctggagactgtattcccaccgctttgcgtgatatacagttatcatttctcagtattgaaccaattgattttactcataagattgggacgacactttcgtctgaatatgaggcgtttactactgaaagtcgtgagcgtttcttccaacagagatgggttctgcaaaataacagcagtagaatgggctaccgttttgcagaaaattcgttaaaactgaccgcacctcttgaaatgctttcctatgcggcacctgctggcacagtgcaagtgccacctgatgggcaacctattgtactaatggcagatgcacaaactacaggaggttaccctaaaattgcttgcgtgattagtgctgatcttggaagacttgctcagacatcgattggcagtgcggtgcagtttgaattattaagccgaaaacaggcggtggcacgttttaaacaagatcagaactatttagaggatattcggagaaaggtaaatgaaacagattgatttaaatgtagatcttgctgagggctgtgccaacgaccagcaacttttacagcttgtcagttcagcaaatgtttgctgtggattacatgcgggtgattacaacgaaatacgcgaagcgattttgtgggcaaaagaaaacgatgtacgaattggagcacaccctagttttcctgatcgtgaaaattttggtagaaccaatatgcaattgccagatgatgagcttaaggtttgtttattttatcaacttggggcagtcaaagcattatgtgatgcgtctggtgtgacgatggaatatgtaaagcctcacggagcattatacaatatggcagcgaaagatcctcatttagccgcacttattgcagaaacagtgaaaagtgttgatccttcgcttaagttaatggggctttctggcagtatcatgctgactgttgctgaacagcacggtctagcgactatctctgaggtctttgctgatcgacattaccttgctgatggttcacttgtgcctcgtactcgtgatgatgcaatggttgagaacgatgaggaggctatttctcaagtgttacaaatggtgcttgaaggtactgttccaactgttgatggcggtaatgtggcaattaaagcagacagcatctgtttacatggtgatggtgaacatgcagtcgtatttgcaaagcgtattcgcagagagttaaaggagaaagggattttggttacaagttcaatttagtaagaattttactaaaaataggaatagatgttatttgttcgagtcgcctttcttttggttatttttcttttgtaaagcaaagaaaaatagcattgatttctaaaacaaaacataaggaaaacacaatgtcaaacaataaccgcagtgcccttattggagcggcatttttaatggcgacttcagccattggaccgggtttcttaacccaaacagcgacatttacccaaaacttatttgccagttttgggtttgtgattttgctctctattttgcttgatatcggggctcaattaaatatttggcgaattattgccgtttccgaaaagaaagcccaagatgttgctaatgcagtattgccgggtgcggggtattttctcgcattgcttattgtgatgggtggcttagcgtttaatattggtaatgtgggtggtgcaggcttaggtttgaatattcttactggagtatctcctgaaaagggagcaattatcagcggtattattgctgttggtgtattcctatttcgtgaagctggtaaagtaatggatagatttgctcaaattatggggtttgtgatgatcgccttgactgtctttgtggcagtaaaagccaacccacctatcgctgatgccgttgttcacactttcttacctgaaaaattagatgttattgcgattgtcacccttgtgggaggtacagttggtggctacattacttttgccggagctcaccgtttattagatgcgggcattaaaggaaaagaaaacttaaaagaagtgagcagaagttctgtttctgcaatcttaattgcttccattatgcgtgtggtgctgttccttgcggtattgggtgttgtttcaatgggggtccaactggatccaaaaaacccagcctcaacaccgtttgcttacgttgccggtaatgtcgggttaatgattttcggtatcgtaatttgggctgcatctattacctctgtgattggtgcggcgtatacctctgtatctttcattacatcattttcaccattcatcgaaaaacacaaaaattgctttatcgtggcatttatcgtgatttctaccgttgtgcttgctaccataggcagaccagcccaagtgctagtgttcgtaggaacattaaatggtttaatcttacccatctcactcggtttagtcttattagcagcttataaaacaaatattgttggtaactataaacaccctatttggatgacaattgcaggggctattgttgtcgtaagcatggcaattttaagtattataactctctcaaaatatgtttttgggctgtttacttaattgatttaaggcgatgatagcaattttcggtttctctttacttggaagagaaacctttttctattatgatcttgtctaaatttaacgttgctgtgtaaacatatattgcaaatgtataaaaatctatccttacttttacttgatgatttgttcgatttagaattagttgcgggtcttactcaatgtgagaaaggtaattaccttgattctatggtagatagacaacaaggaatgagtggctatatgttgcaattaactacttttggtacaggcattattttcgatggtaaacattctttttccactcatcgaggacaattgctactattcacaccaagtgcggttcaacattatcacagacatccagaaagtcagtattggcactataaatggatctattttttaccaaacccaaaatggaataaatggttaaattggtcaaatatagaggaaaaaatagggcgtattaccattggtgatgaccgctactttcaggaaatcagtcagcttttcagcaaaattgaagtcgaattgaaatcaagtaaattttttaaagaagatgtagccaccagtctattagaatacttacttatgaaaagtatttctgccgagaaaattgaagttattccagtaattgatcagcgtattttaaatgtttgtgatttaattttgaccaatttggctaaaaatgacagcttagaagcactagcaaaaaaagtatttttatcgccatcaagattatctcacctttttaaacaatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgatttatgcaacgttataaacaaggtatttcaattgtggaaagtgcactttttttgaatcagtaaagttacaagcacatagaaaaagcttatgttgtgacgggctgaatcggttgtagaacatctgcccataattggttaataatgttacttaactgttagggcagattgatttttacgtgtatgattatgcaaaatattgtgctagatcgtcacttccgccaatatattgcccaccgataaacacttgtggcacgcttgttttgcctgtgattgcacgaacagaaattgtactcgcatcacgacccagtatgatttcttcaaaggtatagcccttttcttttagcaatgtttttgcttttgcacagaatggacagccgggttttgtgatgatggaaactgaaggtttttctgtccaatttgggtttaagtatttaatcattgtgtctgcatcagagactttaaatggatcgccaggttcttgtggttcaataaacattttttcgactacgccattttttaccagcatagaataacgccaagagcgtttaccgaaaccaagttctgttttatcaacaagcatgcccataccgcttgtgaattcaccattaccatcgggaattactgttacattctcgctttcttgatcagctttccaagcattcataacgaacgtatcgttaactgatacacaaataatatcatcaacacctaacgctttaaattcacatgcaagttcgttataacgaggtaaatgtgttgctgaacaagttggagtgaacgcacccggtaaagaaaataatacaaccgttttattgtcaaacaaatcggcggttgtaacatcagcccattgatctccttggcgtgtacggaatgttacttgaggaactttttttccttccatagtcataattttttctcctatataaagattagttgataaaaaatatgattttaagtttaaactatgttatagtcaaaaacaatcaaaaaaagttatttaattgttaatttctatgataggtgtacagaatgaatattcgagatttagaatatctagtttctttagctgaacataaacattttcgtcgtgctgccgatgcttgttatgttagtcaacctactttaagtgggcaaattagaaaattagaagatgagttgggtatcgtattactagagagaacaagccgaaaagttttatttactcaatctgggttgcttttagtcaaacaagctaaaactgttttacgagaaataaagctattgaaagaaatggcaagtaatcaaggtaaagaaatgaatggaccactacatatgggtgtcattccaactattggaccctatttattaccctatattgttccggcactaaaaaatacttttcctgacctagagctatttttgtatgaagctcaaacgcaaaagcttttagaacaattggaaacaggtcacttagattgtgtcatattggcatcagttgatgaggctgaagcctttattgaagtaccgatgtttaatgagagaatgctactggcagtttcagacgaacaccctttatcaaaagaagattcgataaaaatggataagctgaaaggatatgaaatgcttatgctggatgatgggcattgtttacgaaatcaagccttagattactgttttgctgctggggcaaaagaaaatcagaattttcgtgccacaagtttagagacattacgtaatatggtatctgccaatacaggtattactctcattcctgaactggcactcttaaacgaaggttcgagaaaaggaataaaatatctgccatgtttctctcctgagccatctagaggtatttctcttgtttatcgtccaggctctcctctaagagggcgatatgagcgaatagccaataaagttagtgaaataataaaacctttactaaataatagaaaaaacggtaattgaggtataacagctatataatagctgtataaatatctaattgtttggaaaaactaaaattacatcagggataattctgttggcttttaagtctgctatagcaattattaattccaatttgtttttaggctatttttttaataagtcacgaatctctgttagtaatttttcttcgtttgaaggtgtaattaccttttctacttttggttcttctttcttcaatttatttaatgctttgatcattaagaaaattgcaaatgcaataatgataaaatcaaatatattttggataaacataccatattttaatgtcatagccggagttttatcggttgcttcttttaaaacaatatgtaagtctttaaaatctacgctactggtgaaaaaacttaatatcggcatgatgacatctgctactaatgagctgacaatcttaccgaatgccccaccgataatcacaccgacagccatatcgataacattgccccgcatggcaaactcacgaaattctttaataaaactcatcacatactcctaaaataaacaaatataagtttgaatagatcgtaaaaactttcagtttgatgtatagaaaattgatattattctctaaataaagaaagcattaggttgaaaaagtttctctatttctgttacatattttttatcacttaaataaacaatgacatgatcgccactttcaattactgcatcttttcttgcgatgatcacagtatcttgtcgcaaaattgcaccgataattgcaccattgggtaattttaactctctaagtttacgtccaattaattgtgatgttgtttcatcgccatgcacaataatttccaatgcttcagcaatgccatgacgcaaagagatcgcatttgcaatatctcctttacgtacatgccccagtaaagcggagatggtagcttgttgtggagaaactgcaatatcaattgttccgccttgaactaaattgatgtacgccatacgctgtattaacaccattgcttttttagctccaagatgcttagccaagaatgccgacataatatttgtttcatcatcactggttaaacataagaaagcgtcaatgttttcaatatgttcttcaaacaataacgatttatcggaaggatctccatgcaatactaaggttttagataatttttccgcaagtgatgttgcacgctctgcattacgttcaataagtttgactgtgcagtgattttccagtttttttgcaacacccacggcgatattacctcccccaataatcatcactcgtttataaggtttttccaagcgttgcagttctgacatgaccgctttaatataaattgttgcacaaataaaagttacctcatcgccggcttcaataattgtcgaaccctgcggacgaatcactttatcttgacgcaaaatagataaaatacggcaatcaatatgcggcatatggtcttttagggcggaaagagaatagccaaccaaagggccaccataataggcttttactacaacaatactaatattttcattagctaaatgagctacttgtaatgcaccggggtaatcaattaagcgagagatttcttcagtaacaagttgttccggtgaaatgatatgatcaatagggatcatgtgcggttgaaataatttatctttttcacgccaatattctgcatcacgaatacgtgcaatttttgtcggagtgttaaataaggtataagctatttggcaagaaatcatattcgtttcatctgaacttgtaacagctactaataaatctgcgtcaggtgctcctgcttctcgtaaaattctcggtgatgatgcagagccgttaatcacttttaaatcatgtttatcttgtaaatgtgccaaacgaacagcgtcattatcaattaacgttatatcattgtcttcactcactaaattttcagcaagtgttgttcctacctgaccggcacccaaaataataattctcatcaattccctcttttaatttatacagattgaatacctttatttttcatatttcaacttcacattaatttctgataagttttatgattaattgggcagttttcttaatttggcataataaaaaccgtcacctccctgttctgttggaacaaattgatgaccaatttcctccccaatggtaaaaggcaaaggttctaattttgcatcattatgcttggctaagaaatgctgaatttgttgactattctcttcaggtaataaagaacaggtcgcataaactaaaataccttgtggttttaattttttccaaagggcttctaaaatttgtccttgcaattgcactaggggagtaatatcactttcttggcgtagccattttatatcagggtgtcgacgaataacaccggtagcggaacaaggagcatctaataaaattcggtcaaattgcaccgcactttcagatttaaaggtcagtcctatagcattaaaatcaatctctgataaccattgcttcggctgggttgcatcaccacaaattattatagcttgttgtttcatacgaactaaattttctttcacacgttgtagacgagcaggttcaatatctaaagcgatgacttttgcgttgggtgcttgttctaaaatatgtgtagtctttccgcccggtgccgcacaagcgtctaaaataagttcgttattttccggttcgagtaataaggctgaccattgtgcgtgtagatcctgaacgctcacccatccttgttcaaaatagggtaataaattgaccgcacttgcttgatgtaggcgtaatgcttgtgggtgattcgttgttgatgtagatattcctcgctccattaaaagttgttgataatccgcaatagaacaatgttgtaaattaatgcgtagccacatcggaggtttttggttatttgcttcaacaatttcacgccaattggcataagattgttttagtttattcactaaccattctggatgtaaggtttgccaatgcttatccactatcgccaaaatttgttcttgttctcgcaaaaagcgacgcaaaacagcatttaacaggccacggaaactatcggattttaaacttttcgtggcagaaacgacttcgtccactgcagcatgagcaggaattcgggtatataaaatttggtataaaccgaccaacaacaagcagtgcacgatccgagttttacctttcaaaggcttatccagtaggagttgaatgatgcgttctaagcgaggtaacacacgacaaataccaaaacaaatttcttgtagtagcggaaaatcttgcggtttgaccgcactttgttgctcaggcagcaaggtagaaagggatttaccttgaactaaaacttgtaaaattacttctgccgcaagcacacggactgagcgaggcgtgaaaagtgcggtagatttgaccgctcttttagttttgttgtgctgagatttgctcataggacttgtcctatcttaaaccaatccgcacggctgtttaataaatctcgtgctgacatcggttttttacctgcaggttgtaattgctccaagtttaatacaccatttgctgtcgctacttgaatacctcgtttatctgctgcaagaatggtgccacaaggcttattttgatgaggtaacactgaggcttgataaacttttaacgtttgtagcgtgccttgactgtcttgtgttacaaaataactcattggccatggattaaacgcacgaatacaacgttctaattgttcagcggataaagaccaatctagtttagcctcttctttagaaagtttttctgcataattactcagactttcatcttgtacttccgctttaaatagaccttgttctaaaccgtccaaaacctcaagtaaggcttttggtgcaatgttagccaatttagtgtaaagggaggttgaggtttctgtcggtgtaatatcacaacagactttatgtaacatatcgcccgtatccagcccctcattcatttgcataatggttacccctgtttttttatctcctgcccaaattgcacgttgaataggtgctgcaccacgccaacgaggtaaaagcgaaccgtgtacattgagacaacctaaaggaaatgtttgtaacacagccaaaggtaaaattaacccataagcaacaactaccatcacgtcggcattcaatttactcagatgttcttgcacctcaactttacgtaaggatttaggttgataaacgggaatatgatgtttttcggctaaaattttaaccgcacttgcccgcaatgtttgccctctccctgcaggtttatcgggctgcgtgtaaacagcaaggacattatgttgagattggagtaacgcttgtaaatgttgtgcggcaaaatctggtgtaccggcaaaaataatatttaatggtttcataagataagctaatgttctacgttatgtaattgataaaaataaaaggcggacgatccgtccacctattgtttaatttaacgattttttgcgatctgtttttgcaatttgagtagtttttctttcatgcgttggcgttttaatggcgacaaatgatcagcaaaaacaataccatttaaatgatctatctcgtgttgaatacaaatggccaacaaaccatctgcatctagcataaactcttctccctgacgattttgtgcttttacttttacagtctctttacgaggcacaaaaccacgtaaaccaggtaatgataggcaaccttcttcaatacctgtttcaccgaaactttcaagaatcttagggttaatcaacacaatttgattttctttagttccttcaatatcgatcgtgataatacgcttatgtacatttacttgtgttgcggctaaaccaatcccttcttcgtgatacattgtttcaaacatattatcaataaaggtttgtaattcttcgtcaaaaacgcttacaggttctgcgaccgtttttaagcgttcatcgggataaattaatacattcaataatgccataagttcctttcatattttatgttataaattcaaattgaattcattttactcgtttttataggcttttttaagaaataaaataaggaaatgggaaaatatctcaactgagatgcgtaaaaaacttcagcgagagcgatttaccggcaaaagagcggtaatttctaccgctcttttttgggaattgtgttatacgcctttatgttggaagtacaaaactgttgcggcaacccgagaatgaacgtttaatttacgtaataaattgcgaatatgtacttttacagtttcctctgaaataaataattgtcctgcaatttgtttatttgctaatcctgtcgcaatgagtgccagtacattcatttcccgatctgtgagggaataaataggatcatctttatgttgacgttctaacagtaaatttttgatcgattcactgagaatgacttcgccttgtgtaactcgttttatctgagagagtagggtatccggttccgtatcctttaataaataaccgtcagctcctgcatcgattaatgtgcaaatatcatttttcgcatcagaaacggtaagtattagaattcttgcatcaattccttctgtgcgtaaagcctttaatgtatccagtccggataatcctttcatatttagatctaaaatgatcaaatcaggttctaactgcaatgctagatttacaccttcacttccacttccggcgtcacctatgacttcaaaagattcatccagctcaagcaattgtttaatacctcgtcgcatcaaaggatgatcgtctattaagagcacttttgttttatcagacattgattttgtcctcatcatgagagtgcaaggcggctatgaaaaggcacgatttttgttccaccgttgcagtccggtaataattgataaaattgcggatagttaaaattatgctgcacgattttatatgggttgttgtttttatccaagctcgccgattgataaatttgatttatctcacgaattttctgttcttttgagccttcacaatgtcgatagatttcaatgtggttttgttcgtctaaaatatagacattaaaacttttatcttcattatcttcaaagaaaaattgtaagaaaccttcgctcgcaaaagcatccatttcataaggataatgtttctgttctgctaaaagtgcggtttctttttcctcaatagtattacgtagttcattatcaaatacactattatttatcgaagtgttttgcatttcctgtaagctgagtccacgctcttcaaagaataattgccagtttttacccgctattctcaacatattattttggggggcatcggtatcaccaattcgtatatcaatatattttttgataagtgcatggacaatattgcataaggttttttggtagtgttggctgtaacaaaagacgttaattgattttggcggtgttgagccgggataaattttgtttgataacacttttaatgctaatagaatggcattggcaccctcaaaatgcaacgtgcggatttcattccagatatttctataagtgaggtcaatacttcctacgagactttcttctgaaggcccaaaactgaataagtcacttggtaaaatagtcgacttactttgcaacaaatgagcagttggatcattagttaaattgattgtaacggagagatgttttattttgcattgttgagttaattccttatttgttgcttttttagtacgggtaatagggaaagataaacgcaaatcagcaacgaaattacgtagcgttttaagagatacagtatcactatgaatataaagcgaagtgattggtgtaagcaacccattaaaataggcccatgaaactaatttatttagattttcgccatattctatgtggcgtttttgacaaagtccttgtacatccggtttttgtgttactaaataccaaccggctttgaagaatttattttgtttcacttcaatgaatgttaagtgcggttccgataaatcaagggaaatagcttgattgagcaaggtgatttttcccggtaattcttcaaaagcagtgtaaagttttctggtcaagatagaaacatcttgtggcatgatactggcatttacattatgtttacgcccgaagttaattagatttcgatagctcaacataaggtattgcatcaggtcattgtgactttccttaacttttttgattttccaagttgtacgttgatttagattttgaagaagattatctgaccaattccactgctgtgtaagttgatgcagtttttctgaacgccaattattttcttgttgttgaacgatatactcactggctttcatataaaagcaacgtctcacaaaatctaatcttttgaattcattcagttttgttaaaaaagaactcactcgctccaacattgctaagtatgggtcatagtgatagtcaagatcgttattcagcagacgttgtttgaattcttgtgcaattaaatgagtatttggatattcataagaataactttcgagtaataagattttgagtaccgatttatagggggaatcgatacctttatatagttgccatagacttgcaccaaaatattcgttcgctgaaaacgcactcagacaaccaaaatctacccaatcatctatattgatttgctttgttttgatgagtcgattgacttcagaactataatcttgttcatttgctacctttagatgtaaccaaagtagcggtttaccggcaaggcgaataacagaacgatagaactcctccagtaataacatatattgtgcggagccactattttcagaagtaagtgcatcggcataacgaaagctacgaaaacgctgttggtcaattaaataaagattaatttctacgccaagacttcttgcccattgttgcaataagtgatttttttttgaaagttgttctttatcttctaagctaagatcttctcggtggcatacccaaatatctaaatctgagcttggtgtttggctgatagaaccgatacttcccataacgtaaacacctaaaataggcgtgtctgtgagatgttgtaatgctgccaaatgtgtactaagttgctcaaaatctccctgagggagatgtgtagttaaaaattcctgttggtattttgataattgaaaacgagcaatgccatgtggggcattcggtaggtaaccgcccatcaagggatgatttatgtgtaacaataaggtaagaagttgtaatacacgttggaactctactgaagttgaagatagtgctctttctaaacgtaactgatcaacaaattcaacttgtttcttcgcttgttggagatcgtatttcaagttattctctatctagataaattaatcgttgcttactctatcactccccttgtatgaaagcaaaaaaatcgagtaaaaaattaaatctacactgacatttcagagtaacagtgataggatattgcgattacgagtctaatctatatttctacatatgagtatcaacaagaccctaaaaattgcgacacgtcaaagtccgttagcattatggcaggcaaattacgttaaaaatcgcctacaacaacgttattctcatttaagtgtcgaacttgtccctatcatcacaaaaggcgatgttatcttagatacacctttagctaaaattggcggaaagggattatttgtaaaagaattagaaaatgcgttgttaaatggtgaagcggatattgcggtgcattcgatgaaagatgtgccaatgcaatttccgaaaggattagagctaagtgtgatttgtccgagagaggatcctcgtgatgcatttgtttcaaataagtaccgcactttagacgagttaccgcaaggtgctattgtaggaacatcgagtttacgtaggcaatgccaactcaaaaactggcgagcggatctcgatattagttctttacgtggtaatgttggaacaagattaaataagttagatcagggtgattatgatgcgattatcttagcttcggcaggattaattcggttaggattgactgaacgtattcgctcttttattgaaattgatacgattttacctgcttgtggacaaggtgcggtaggaattgagtgtcgggtagatgatcgagatgtgcaatctttattgatgccgttggctgatcagacgaccacttattgcgtattggcagagcgtgcaatgaattttcatttgcaaggtggttgccaagttccgattggtgcttatgcaattttagagaataatcagttatatttgcgtggtttagtgggagatgttcacggttcacaaattctatcggcagaagggcaatttgaattatctcttgattttgaatcatcgcaaagtgcggtgcaaaaagcggaagaattaggcgtgagtattgctgaacaattattacagcaaggtgcagataaaatcttacaggctgtttatcaatcataattgagtaagaggcaatggcagttttaattacacgacccggtgagcgaggagagcggcttgttgagatgcttaataaagccggaattatggcactccatttaccgcttatttccattatagcggggcaagaattaaatcgattacccaataaattacaacaattaaattgtggtgattatgtagttgcagtatctaaaaatgcggtggaatatgcacaaaaaaccttaagtgcggtaggtttttgttggcgttcggacttatattactttacggttggacaacgaactgcagaatattttgcgagccaaatagaaaattcggtgtattatcctgttgagcaagaaagtagtgaaggattacttaatttacctcaaatgcaagaccttcaggcacggaatattttgattttgagagcgaatggaggacgggaattttttactgagcaggctattttgcgaggagctaaagttgaaactctggaatgttatcaacgaatgcccattgaatataataagttggaaaaaattagtttatgccaacgtattggggtagataccattgttgtaacaagtcaagagatgttaaattacttagtgaaacttgtgccaaccaatgaaacaggctggttattcagttgtcgtttagtaacggtaagtcaacgtatagcgacattggcaaaaagtgttgggtggacaaatattgttgtggcagataaagcggataacttgagtcttttccttgcattgcaacaatgaaggctggaatttcatttgattaaggaataaaaattatgacgaagaaacattcaaaggttagcacagaaaaacaggataatatatccgtgcaaaatcctcctttggaggcagaattgcaatatgaggaagtaccggctgaggatattgtaaagcaagaaagtaaggctaaacaggaaactttttcaaatcaggagcattttatggaaagagagaatgaacaagttggcgaaaaaagaacagcagctcaagttgaaactgtagtggtgaaaaaaggagggacagtcattgctctattagctttgcttattgcattgggtattgggggagctggctattattttggtcaacaaaaagtagaagaaattcagcaaaagttgaccgcacttagccaaccgtcggaagctgtgccgctagaaaacaatgatactttgttggtaacagttgaagaatataagcaaacttttatacagaagattgagcgactggaaaatgaaatgacaaaacaaaaccagcttattcaaagtttacaagcacaagtaaataaattggatgcggttggtaaagttgaacaatcgacggattggttgttgtttgaaacagattatttgttgaataatgctttacgtaaaatcgtattggataatgatgtggagacagctattgcgttattgaaagtggcggatgaaactctcgttaaggttaatgatcctaaagtcattaacattcgtcaggcaattaatgcagatttaaaacagttattatcagtaaataatgtagatcaaaatgccatcatgcaacatttatctcaattagcaaacggtattgatgaattagttgtattaaatgtgaatttcgatgagcaagaaaatactcaattaagcgattccttacaggattggaaagaaaacgtagaaaaaagtgcggtatcttttttaaatcattttattcgtgtaaaacctcgccatgtgaactcaaaggaattacttgcaccaaatcaagatatttatttacgtgaaaatattcgtttacgtttgcaaattgcgattatggcggtccctcgtcagcaaaatgatttatataaacaatcacttgaaattgtaggttcttggataagaagctattttgatacaagcactgaagtggcacaaaacttcttgaaagagattgatgaacttgctgagaaatctatctatgttgatgttcctaaccaattaaaaagtttgcttttgttggataagttattgaataaggaacagtcatctgtacaaaaaattgaaatgacagtagataaagacttggttagctcaacagatcaagtatctgaggaagggaaaacagatcaagctgttgaaaaatctgatgaaaagccaattgaacagcctgttgagcaagcacagtaataggagaatagcgtatgttcagagttctatttttaatgctggttttattggctggattaattggcggtccctatttatcaggtaaacagggatatgtgttaattcaaacggcaagctataacatcgaaatgtcaatcacgatgttggttattttctttgtgattttaatggccattgtttatctgattgaatgggtggttacacgtttcttccgtttgagtaataatacctatagttggttctctcgtcgtaaacgtgttaaggcacaacgtcaaactttggaaggcttagtgaagatgaatgagggcgattattccaaagctgagaaattgattggaaaaaatgctagacattcagataaaccaatattgaatttaattaaagcggcggaagcggcacaacagcgaggcgatgattttgttgccaatcgctatttaattgaagcaacagaattagcaggtacagacagtttaattgtcgaaattgcacgtactagaattttattgcaacaaaataaacttccggcagctcgtagttcggtggatagtttactggagatgacctctcgtaataaagaagtattaaagctggcagtgaaaatttacctgaaatctgccgccttccacgcattggataaaattctagatcaaattgaaaaagttggattatattcttccgatgaattcaccgcccttcagcgtaaagtcgaagatggtttattagacgagaaaatgaacgaagagggtgttgatgggttattacgttggtgggatgaacagcctcgtaaacgccgtaatgatttatatgttaaggttggtttaattcgtcgtttactggacagtgatgatcatgaaagtgcttatgagttagctattgatgctctgaaaaaagttgaaaatagtgttgaagctaatgttgctctttgtactcaaattactcgtttacaaccggaagataacagtaagttattaaaacttttggaaaaacgtgcaaaacagtcaaacagtaaagattgttgctgtgttgaacgtgcgttaggttacctttatgtgcgtaatgatgatttcgctaaagcggcagaagcattcaagaaagtgatagagaataaagcgagcttacaagcaaatgatattactatggcggcttatgttttcgaacaggttggagagcttgaattagcacaaaaagttcgtgaggaaggattgagaaatgtgatgtcaattaaagagtcggaaaataaaaccaaaaaaacagcagaaaatccgaccgcccttttagaacaaaaatcctaaatatattgttaaaaatgcccttaaaaatcattgttaagggcatttttataggttttatttttcctcaatgaaagttaaggctttttcaataacctccacaccggcatgagatttatggatgttttcactcatatagcgtcgccattgccttgcccctttacattgttgaaatgcacctaataaatggcgagcaatatgattaagataaacgccttgactcaattgttgctctatgtaaggaaacatattttctattgcttgtcttggcgtgataattgcacaagacggatcaaataacgcttgatcaatatagcccaataaagacgggttttgataagcttcacgcccaaccattactccgtccacataattgagatgttgttgaatttcttcaagcgttttaattccgccattaatgctgatcaataaatgaggaaaatcctttttcaactggtaaactcgctcataattaagtggcggaatttcacgattttcttttggacttaaccctgatagccatgcttttctagcatgaataataaattcttggcaaccgatattatgtactttttcgataaaatcacatagaaattcatagctatcaaactcatcaataccaagacgagtttttactgtgactggaatattgaccgcactttgcattgcgttcacacattctgctactagagcagcccttgccatcaggcaagcaccgaacataccattttgcacccgatcggatggacaacctacattcaagtttatttcttgatagccacgttcttcagctttttttgcacaatattgcagtttttcaggatcacttccgccaagttgtaatgccacggggttttccgatacatcataagcaagatgatcgtatttggcgtgaataattgcaccggtagtaaccatttctgtatagagtaaggtataccggctgaactgccgatggaaaaaacggcagtggcgtgtagtccagtccagcataggagcaacggaaaaacgacctcgataaaagtgcggttgattttgcttcattttttacttgtttgataattgaaacggttagggtttagcgttttcgtgagcttttctctttttgtgcatgccgacggaaacgcccacgcccaaatgataaagtaatacaggattaatttggcgtgaaacaaaagccgttacaatacaatcaatgaatgcttaaatcaagccaatttgatgagttgttattgttggtttaaggattgcgtacttaccactcaatatctgagctaatacggtatgtctaagagggaataatcgggttattgcttagatttaatatgaaaggtaatttcatgaggtgaagaaattccggtagattttagtcacttgactagaaaagtgaagtagcaacgtaaagaaaaattggtacactctttttaagtttacgttgctgtcgttttagatatttatttaatcccaggagctttccaaagcgaaatggttagtcctctgtcaaccaatttcaattgctgctggtatatttcttgccatttttctttatgtatttgatataaattatgatttcttgcatttggttgatgttgtctttcaaattttactaatgttttacctgcttcatgtaatgaagtataaataccagcacctactccagctgcaatggcacatcctagagcagttgcttcttttactacaggtacattaacaaccaatcctgttacatcggctagaatttggctccataatttcccttttgcaccacctccggcaaaaacaatactggtaagattaacttggctgaattgctggacttgatcaagattacatgaagatacaattgctgcattttcttgtaatgctctaaacaggactgatttgttacatttttcaggatcaatcgaaaggttaataaatgatggggctgcgtgataccaagatttgaaatgcatagcatcagagaatacaggaataacatcatttgaacctacgggtatcttttctgccatttgttccagtaatgtgtaagcatcaacacctaagcgatgagcgacggctttttcttcttcacagaaagcatctctaaaccaacgcatagtaagccctgtaaagaagctgatagattctgcttgtaccatcggtgcaatgacatgcggattgatgcgtatattcattttaggatctgtcattgcttgtggtaagtttacgacctgttgccagaaagttcctccaataatagcagcttgccccggttctgtaatccctagtccgatacaacctaattgcacatcaccaccaccaacaacaataggcgtgccgactattaacccggtttgctgtgcagaatgggcggttacttgaccgagtatttcacctgtctcttttactttcggtaaaatagcaggattgagtccagccatctctagtaaagtgtgctcccattttcgggtttttaggttgagaatgccggttgtgccagcatttgaaggttcgacggccagttctccgctaagcataaatcctaaccaatcgctaatcatagagagaaaatggacttgagcataaagattaggttgatgatgtgcaagccaaagtaaacggggtaatgcacttaatgccagtgtttgaccggaggattgataaacttgttgttcaaactgatactggtttagagactttaattgaataacttcttctacagatctggcatccacattaccgcacgcccaaatcgggtttttattggcatcgtataaaacaatgccttcacgcatggagcaagtcgatatagctataatttgtttagcatctatttggctggtagctaaaacttcttgaatacataagcaagcaaggtgccagttattttgtaaatcaaagcccattgagcctgggatatttgggtcggaaatatgtgtccattctttttgtgacgtagcgatttgatttccttcaagatcaaaaataactgcacgaatactacctgtgccggcatctaatgccattaaataacgggataattgcattatgttttcctccgattatctgaggaaaatcgttacactactttagctaaaatagtgcgtgcggttttttcctctgtgactaatgaattgatatgctgtcctaaaagtgcggcaataattgcttcaactttatcttcaccaccggcaacgccaataatagtcggtattcgcttgatactatctaatgaaacgctgattaattcttcgtgaatcggcatatccggttgaatgtttccattttcttgcaagaaatagcctaaaatatcccccacagcacctttttgacgaaattcatctagttgtttttcattgatgatataacctgtttgaagcaaagtggagcgtgttttctgaaccgtagatccgataccaacgatggcaacatcagccatactggctgctaacataatatctcgtacatacccctctttttggaaaagttgtgcagcttcaggtgaagaagctcgtagaggggcgggaataatactgatagcacagctactatcaagctgcccaatactttgcatataaggtccaacaccgccggttaaggtgattaacttaatctggttttgtttaataaaatcattgcagtgctttaccgtgtgcatcacagtgtcaccaaacccaaaagagagaacttgcttcgctttgagtaatcccatcaacatttgagaggctccgacacctaagcgggcattgacttcataattctgtaactctggcaacacacgaatatgctgtaaatgaaaccgctgttttaaagcttcttctagttccaagcatcctttataacgagagttgatttgaactttgattaagccgatttgtcgccctttttccagtaagcgtgaaacttttaaacggggcaagcccaatttctcaccaatttcattttgtgtcagattatcgtggtagtagaaccatgcaatgcgtgctaataactcttcctcgttaaagcccgcctcgtagtgattatctaaatttatcatttttttaccctgtttttattattcatctgattttaattttaatcaaatgttctttttctaaagtgtgaattcgatcacattttacatttaatgtgaaaaaaagacataaaattcttaaaaatgtgaagtttatcacaaaaaaatagaattttttgggttatgatttggaacaaatgataattaaaattttcatttgttcaatttgaagagtcaaaaatgaaagagacagaatctaatcctacacctttactggaagcttgtgatgtaagtaaagctttctctggtgttgaagtactaaaatccattaacttttccctttattctgggcaggtacatactctactgggtggaaacggtgctggcaaatcaaccttgatgaaaattattgccggtattcagttgcaagataccggcacgttaaaaattcatggcaaagtccgaaccaatttaacaccaagcaaggcacatcaattaggtatttaccttgttccgcaagaacctttgttattttctaatttgagtgtcaaagagaatattttattcggtttgccaagaacaatggatttacagtcaaagctcacagcgttgttgacggaactaaactcacatttaaatttggatatgcaggctggtttattagatgttgctgatcagcagttagttgaaattatgcgaggcttaatgcgagatgctcagattctgattttagatgaacctaccgcctcattaacaccagtggaaaccgaaaatttattcggacagataaattccttactcgtcaaaggggtagggattgtttttatttcgcataaattgtctgaagtttggcaaattgctgattgggtgagtgtaatgcgagatggttacattgccttaagcgagccaattgacaagatcaatcacgacgatgttattcaggcgattactcctcgagctaaaaatgcatcattaacagaaagtcagcagttgtggttggatttaccagggcataagagggtgaaatcgaccgaatttccattattgacagtagaaaatttcactggtgaaggattccgagatatcaactttgaaatttatcctggcgagattttaggattagcaggcgtagtcggctcaggtagaaccgaattagctgaaacgctgtatggtttgcgtaaagccaaatccggtaaagtgatattttgtgatgagctaattaattcactgtccgttaagcaacggcttaaacgaggcttagtgtatttgcccgaagataggcaagcctctggattgcatttagattcaccattaagttggaatacctgcggattaacctatcatgatatgggcttttggattgatgagtccaaggagaaagcaattttagaacgctattaccatgctatcggaataaaatttaatcatgttgagcaatcggtacgtaccttatcaggtggtaatcagcaaaaaattttgatcgcaaaatgtttggaagccgatcctcggttgttgattgttgatgagccaactcgtggcgttgatattggtgcgagagcagatatttatcaattaataaaaagtattgccaaacaaaatgtagccgtgttgttcatttcatctgacttggaggaaatagaacaaatgtctagtcgagttttggtaatgcacgacggtaagcttagtcaatcgttgaaaggtgaagatatcaatactgataatattatgcgactggcattcagtagttaggaggcattatgtggaaatttattcagaacaatcgtgaattaactattttagctgccattttgttgttatttggattgctaggtgtggtggatgactttagcttacaaactctcatgatgatttttaactcgacccaaatattagctttgttagctattggtgcgacctttgtgattttaactcgtaatattgatgtctctgtcggctcaattatgggattaagtgcagtagttgttggattagtgctaaattcaggttattccctactgattgcgtgcactattactttactgtgcgggattattgcaggtggggtaaacggtgtattagtctcagtacttagaataccggctattgtagcgacattggggacattgggtttatataaaggcttaatgttagtattaactggcggtaagtggattgaaggtttgccacattcattgaaaacattgtcagaagaaattgtattggggttttcgcctattgggttagctgttattttcctcattttagtcacgtactacttttttactcacacttatattggtcgttgtttttatgccgtgggggataatttacaaggtgccttgcaattaggtgtaaaggtgaatgttattcgcattagtgcatttgcagtaaacggtctaatggctgctttagctggaattatttttgcctctcaaatcggttttgtgccaaattcaactggtaatgggctggaaatgaaagcaattgcggcttgtgtattaggtggaataagtttactgggtggtgcaggtaatattattggtgctgtattaggggcatatttcctgattcaaattgatacgattttagtactgatgaaagtgcctgcctattggaataactttgttgctggtgtggttctattagctgtattggtatttgacggtagaatccgagtaatgattgtcaataatatcaaacaacagcgttatgcccgttttcttaaagataattcattgtaggagaatcaaaaatgattaagaaatacaactgggaaatagctctcttttgtctactgatactggaaattatcgggttcggtttggttaatcctcggttattggatctcaatgtcttatttaacagcaccagcgattttatttatatcggaatgttagcattgcctctaacactgattatagtcagtggagggatggatatttcatttggatctgtggtgggactatgtgccattactctcggcgtattatttagactaggaataccgttaagtgtagcaattgcggtgacatttgcagtcggatcattgtgtggtgcgattaatgctgtactcattatctatactcaagttaacccgctggttattacgcttggcacaatgtatctgtttggtggtggtgcattgttattatcaggttttgctggtgcaacgggctatgagggtattggtggatttcccgatgtgttacttgattttgcaaatttcagttttggtattattccaacaccgattatttatttcttaataatgacattactgttttggctgttgatgcatcgtactcgtattggtcgtagcacatttttaattgggcaaaatttacgggtctctaagtatagtgctgtaccggttaatcaaactctatttattatttatccgttaattggtttgattgcggcttttgtcggtgtgttgctggtatcctactttggttcagctcgttcggacttagggagttcgttgttaatgccggcactaaccgcagttgtacttggcggtgcgaatatttacggtggttcaggttcagtgattggtacagcaatagctgcattattgattggctacttacaacaagggttgcagatggttggaatttcgaatgaaacatccagtgccttgtccggagcattgttgattattgtacttatcgggaaatcgcttaatacacatcgggcagtagtgattcaatggtggaatcgaatccgagcagtttaaaataagcggttagtttatgatgatttttgtcaaaattgactgcgataaaacccctgcatacttgttgttttggtatgttttttaatcatacactcaattgaggagacgttctatgaaatactcacttttaaaaacaaccgctcttgccgtagcgttaggttttaccggttttaacatggcacaggctatggataaggtggcatttatcccaaaattagttggcgttggtttttttaccagtggtgggcaaggtgcggtcgaaatgggaaaaaaattaggtttggatgtaacctatgacggtccggcagaaccgagcgtatcgaaccaagttcagatgatcaataactttgtgaaccagggttataatgccattatcgtctcagcagtatcgcctgatggattgtgctctaccttaaaaagagcgatgaaaaaaggtgtaaaagtattaacttgggactccgatactcagcctgagtgccgaagctactatattaatcaaggaacacctactcaacttggctcaatgctagttgaaatggtatcaagtcaaatttctaaaccaaaagcaaaagttgcatttttctattccagtccaacagtgacggaccaaaaccagtgggttaaagaggccaaagcaaaaattgaaaaagaacatcccaaatgggaaattgtgacgacacaatttggctataacgatgcaattaaatcactgcaaactgccgaggggatcttaaaagcctatcctgatttagatgcgattattgctccagatgccaatgctttgccggctgccgctcaagcagttgaaaaccttaaacgacaaggtacaatcgttgtcggattcagtacgccgaatgtaatgcgtccttacgtaaaacgaggcacagtaaatcagtttggtttatgggatgttgtgaagcaaggtcaactctctgttgcagtagctaatgaattgttaaaaggtaattctcttaaggttggcgataaattgaatgttgatggtattggtgaagtagaagtatcagcaaataaagtacaaggctatgagtttgaagcaaagggaaacggtattgtgttactacctgagcgtgttgtattcactaaagataatattgataactatgatttctaattatataggagacaatctatggcagatttagatgatattaaagacggtaaagattttggtattggtattcctcaaactaacaagctttttttcgtcaaaggttccagtgcattagattggggaatgcaatcacgtcttgccaatatctttaatcccaaaacaggtaagacaattatgttagcctttgatcacggctatttccaaggtccgacgacgggtcttgagcgcattgacctcaatattgcaccgctctttgattataccgatgtattgatgtgtacacgtggtattttaagaagcgttgtaccgccggatacccggaaatctattgctttaagagcgtctggtgcaaattctattttgacagaactttctaacgaagcagttgcagttagtattgaggatgctttgagattaaatgtatccgccatggctgcacaggtttatatcggttctgaatatgaacatcaatcgattaaaaatattattcaattggtcgatcagggtaatcgctatggaatgcctgtgatggcagtaactggtgtagggaaggatatggctcgtgatcaacgctacttctcactttcgactcgtattgccgcagaaatgggggctcacattattaaaacttactatgttgataggggatttgagcgggttacagcaggttgccctgtaccgattgtaattgctggaggtaaaaaattaccggaattggatgctcttgaaatgtgctatcaagcgattgatcaaggtgcagctggtgtggatatgggcagaaacatttttcaatctgaagcaccaattgcgatgatcaaggcggtgcaagcggttgttcacggtggagaaaatgcaaaagatgcctaccaactctatttaagtgagaaaaacaactaagttaattaggttggctaagttagccaacctatttttcccatgttttctatgataaggagaagcttatgtttgctatgcttgttgaaatcaatataaaagaaggtaaagaaaaagaatttctggaggttttcgaacgtaaccatattggcactcgccaagaactgggaaatttgcgttttgacatattacgagatccggaaatacgaactcgtttttatgcatacgaagtgtatgaaaatgaaacagcactaaattttcatcggcaaactgaacattatcgccgttgtgtaagagaattagaatctttaatgactggttcaagaagtaagaaaatctttgaatggatattaccgaatccttatgtctaaattatcacttattcagcagttaaagcagcaaaaactgagtgttggtatcttatctgcaaattggcttcaacttaatgaagaggtaacaacattgttggagaatcagattaatgtactgcacttcgatattgctgatgggcaatttagttcgttatttacagttggagcaataggaattaaatattttccaacacattgttttaaagatgtgcatttaatggtaagaaatcagttggaagtagcaaaagctgttgtagcaaatggtgcaaatttagtgacattgcagttagagcaatatcatgattttgctttaacgatagaatggcttgctaaacagaaaacaacttatgccaatcaggtatatcctgtattaattggagcctgcttatgtccggaaacgccgatttctgaattggaaccttatttggatcaaattgatgtaattcaattattaactttagatccgagaaacggaacaaaatacccttccgagttgattttagatcgtgtaatacaggtagaaaagcgattgggtaatcgacgtgtggaaaaattaatcaatatagacggctcaatgacgctggaacttgcaaaatatttcaagcaaggaactcatcaaattgattggattgtttctggttctgcgttgtttagtggagaattaaaaacaaatttaaaagtatggaagtccagtattatgtgacatcaataaaaagtgcggtgattatttcgtgatttttataaaataacttgctttttttgagatcatgagtataatctcaccactttcgatatgaaagtcgtttgatgtaatcatttattgaacgtactattacggtatgtaatagataaaatgtccccaatttggaggactaagtaggttcgctgcacttccctttatttaagatgttaaaggtgatggtgtcagtttttttatagctaattttattggagctctggtctaatgcagaaccaaagaatccgtatccgcttaaaagcttttgatcatcgtttaattgatcaatctacagcggagatcgtagaaacagctaaacgtactggtgcacaagtccgtgggccaattcctttgccaactcgcaaagaacgtttcacagtattgatttctccacatgtaaataaagatgcacgtgatcaatatgaaattcgcacacataaacgtttagtcgatattgtagagccaacagaaaaaactgttgatgcattaatgcgtttagatttggctgccggcgttgacgtgcagatcagcctaggttaattaagaggttattacaatgattggtttagtcggtcgtaaagttggtatgactcgtatcttcaatgaagatggggtgtcaattccagttaccgtaatcgaaattgaagccaaccgtgtgactcaagttaaaactcttgaaaacgatggctatactgcagttcaggttactactggttttaaaaaagcaagtcgtgtaaccaagcctgaagcaggtcatttcgtgaaagcaggtgttgaagctggtcgcggtttatgggaatttcgtactgagggtgaagaattcactttaggtcaagaaatcaatgttgacatctttacagatgttaaaaaagtagatgttactgggacatcaaaaggtaaaggtttccaaggtggtgttaaacgttggaatttccgtactcaagatgcaactcatggtaactctttatcacatcgtgtgcttggttctattggtcaaaaccaaactccaggtcgtgtgtttaaaggtaaaaaaatggctggacatttaggtgctgaacgcgttactgttcaatcacttgaaattgttcgtgttgatgttgaacgtaaattattattagtgaaagggtctgtacctggtgcaactaatagtgatgttatcgttaaaccagcagttaaagcataagtctaggagatagagatggaattacaagttgtaggtgcaaacgcactcactgtttctgaaactaccttcggacgtgagtttaacgaagcgttaatccaccaagtggttgttgcttatgcagcaggtgctcgtcagggttctcgtgcacaaaaaacgcgtgctgaagtgtctggttcaggtaaaaagccttggcgtcaaaaaggtaccggtcgtgctcgttcaggtgacattaaatcgccaatttggcgttcaggtggtgtgacctttgcagctaaaccacaagatcatagccaaaaagtaaacaagaaaatgtatcgtggcgcaatcaaaagtattctttctgaattagttcgtcaagatcgtttagtggttgttgaaaaatttgagatcgatgtaccaaaaactaaggttttagtacaaaaattaaaagatatggcgttaactgacgcgcttatcatcactgcaagtttagatgagaatctattcttagcggcacgtaacctttataaagttgatgttcgtgatgtgcaagctattgatccggttagcttaatcgcattcgataaagttgttgtaactgtagaagcggtaaaacaaattgaggagatgttcgcatgattcaacaagaacgtttgttaaaagtgttgagagcccctcacgtatcagaaaaagcaacaaataatactgaaaaatcaaatacaattgttttcaaagttgctttagatgcaaataaagtcgaaattgcaaatgctgttgagcaattgtttgaagtgaaagtagactcagttcgtacagtggttgttaaaggtaaaactaaacgtcgcggtgctaaaatgggtcagcgtagtgactggaaaaaggcttatgttactcttcaagaaggtcaatcgcttgacttcgttgaaggtgcagctgagtaatttcggaggagaaaaaataaatggctatcgttaaatgtaagccgacctccgctggtcgtcgtcacgttgttaaaatcgtaaaccctgaattacataagggcaagccttacgcaccgttattaggtaccaaatctaaaactggcggtcgtaataatttaggacgtatcactactcgtcatattggtggtggtcataaacaacattaccgtgtaatcgatttcaaacgtaacaagttagatatcccagcggttgttgagcgtcttgaatatgatccgaatcgttctgcaaacattgctttggtgctttacaaagatggcgaacgtcgctatattttggcacctaaaggtttatccgcaggcgatcaaatccaatcaggtattaatgcaccaattaaaattggtaactcgttaccgatgcgtaatattccggttggttcaacagtacataacgttgagttaaaaccaggcaaaggcggacaaattgctcgttctgctggtgcttatgtacaaattatcgctcgtgaaggtaattatgtgactttacgtcttcgttcaggcgagatgcgtaaagtattatctgaatgtgtagctactattggcgaagttggtaattcagagcatatgcttcgcgtacttggtaaagctggtgctaaccgttggagaggtgttcgtccaacagttcgtggtacagcaatgaacccagtagatcaccctcatggtggtggtgaaggtcgtaacttcggtaagcatcctgttacaccttggggtgttcaaaccaaaggtaagaaaactcgtcacaacaaacgtaccgataaatatatcgtacgtcgtcgtggtaaataatattaattaaattaagaggatatgccatgccacgttctctcaagaagggtcctttccttgacctacacttgttgaagaaggtagagaaggcggtggaaagcggggataaaaaaccaattaaaacttggtcccgtcgttcaatgatcattccttcaatgatcggattgaccatcgcagtccataatggtcgtcagcacgttcctgtttatgtttctgatgaaatgatcggtcataaattaggtgaatttgcaccgactcgtacataccgcggtcacgctgcggataagaaagctaagaagtaaggggtaaaagatggaaactattgctaaacatcgttacgctcgcacttcagcgcaaaaagctcgcttagttgcggacttagtccgtggtaagaaagttgcacaagccttagaaattctcactttcactaacaaaaaagcggcagctttggtgaaaaaggtgcttgaatctgcaattgctaatgcagagcataatgatggtgcagatattgacgatcttaaagttgcgaagatttttgttgatgaaggtccaagcatgaaacgtgttatgccacgtgctaaaggtcgtgcagatcgtattttaaaacgtacaagccacattacagtggttgtgtcagatcgataatagtagaggaataacaatgggtcaaaaagtacatccacatggtattcgcctaggtattgttaagccttggaactctacttggtttgcgaatacacaagatttcgctgataatttagacggtgatttcaaagtacgtcaattcttgaataaagaattagcgaatgcttcagtttcacgcattactattgagcgtccggcgaaaagcatccgtgtaacaattcacacagctcgtccgggtatcgtaattggtaaaaaaggcgaagatgttgaaaaattacgtaacgcagtagctgctattgcaggcgttccggctcaaatcaacattgctgaagtgaaaaaacctgaattagatgcaaaattagttgcaggtagtattgcttcacaacttgaacgtcgagtaatgttccgtcgtgctatgaaaaaagcagtacaaaacgcaatgcgtttaggtgctaaaggcatcaaagttgaagtaagtggtcgtctaggtggcgcagaaattgcacgttctgaatggtatcgcgaaggtcgtgtaccactacatacattacgtgcggacatcgattataacacctcagaagctcatactacatacggcgtaattggcgttaaagtatggatcttcaaaggtgaaattcttggtggaatggctgcaattgcacaacaaccggaacaacaaccagccacgcctaaaaaggctccacgtggtaaaggtcgtaagtaaggagatttgctaaatgttgcaaccaaaacgtacaaaatttcgtaaagtccacaaaggtcgtaaccgtggtattgctggtggtacagaagtgagcttcggtacctttggtttaaaagcagttggtcgtggtcgtttgacagcacgtcaaattgaagctgcacgccgagcgatgactcgtgcggttaaacgtcaaggtaaaatctggattcgtgtattcccagataaaccaattactgaaaaaccattagaagtccgtatgggtaaaggtaaaggtaacgttgagtactgggtagctttaatccagccgggtaaagtaatgtatgaaatggatggtgtatctgaagaagttgctcgtcatgcgtttgcattggcagcggcaaaacttccaattaagacaacattcgtaactaaaacggtgatgtaatgaaagctcaagaactacgtacaaaaactgttgaagagctgaatgctgaattggttaacttgttaggtgagcaattcaaattgcgtatgcaagcagccaccggtcagcttcaacaaacccatcagttaaaacaagtgcgtcgcagtattgcacaagtaaaaactgtattaaccgaaaaggcgggcgcataatgactgataaaattcgtacagtacagggtaaagtgattagtgacaaaatggataagtcatttgtggttgctatcgaacgtacagttaaacatcctatttatggtaagtttatccgtcgcactactaaactgcacgtacatgatgaacataacgaagcaaaattgggtgatgtagttgaagttagagggtgtcgtccactctccaaaactaaatcgcacactttagttcgtgttgttgagaaagcacaggcttaattgacaacgtatataagtaagaacctagcagaaatgctaggtttttggtttttttgatttatagaaatttttaaaattttactgcttataagcacgatatttaatataaattataactatattttaaaaatgattattgttttttagttttgtaagaaaatctgattctaaccttaaaattatttaaggataaaaaatgaaactatataaatttagaaaagaattatttgtattgactcttttagtctccggcaacagtatatcagcagagatcattgcggaattagatgaagttgtcgtatctgatagtagcagtgtagctgattttcaatcactcgcttttcaaggtggtcgtaaagctagtgatgtatttattgagggtaaagagtttaaaacacgttctgccaccttaggtaatgctttaaccggagaattgggcgtgcattctaacccctttggaggcggagcaagtgctcctgtgattagagggcaagaaggggtgcgtattaagcttttgcaaaatgggtcggatattgtcgatatgtctaatatttcgcctgaccatgctgtagtcgctgatacacttttagcacagcaggtcgaattggtgcgagggacatctaccttaatgtatggtatggcatcacctgctggtgtagtgaatattgtcgataaccgtattccgacttctcgtcctgagaaagggtatgagggagagatcgtttcacgttttgatacagcgagtaaagaaaaagtcttgactgccggatttaccttagcagcaagtgataatttgctgattcgtgctgagggactgacacgcaaatcagataattaccgtgtaccagaggtatatatcggcaaaaaattaaactatctgccggatagccatcataaatcaaaagtgggaacattaggagcgacatggataggcagtcaaggttatttgggtgcatcggtgagttatcgcaaggaccattacggtattcctgggcataatcatgcgtttgattattgttcaggacatttgtttgatactgataatttgagtgcaattacagggggggatggtgaagctccctatcttaatgcgtatcctcatttgatgacggatgaggatatcaatgcttcattgcatttccattgcggaacgaatcttgaaggaggtaagcatagtcatgaaagtatttatggacataatcatgatattagttcagcaggccccgtaattgacatgcgttctaaacgttatgatgtgagaggcgagtggaaagttccgttgcgagggattagcaaagtaaaattatctcttgcttatgcagattactatcatgatgaaaagcatgatggcaaagcacatattgataagaatgattcgcagggaacacaagcaagcaaaaaatatacagccacacttatgtcaggaaaaccggaggcattttattctaatcgtggatttaacagtcgtcttgagatttatcatcaaccaactgagcattttaatggcgtagtgggcgtgcagtatcaaacgcaaaaaactagtgttcagcgtttagccccaaatccaaacagtaatgaaaaagatttaagcggtgagagaaaagagtctgaacgtaacccattagttccgcatactaataaacaactgagtgtatttttattagaacagtttacttggcgtaattttatttttgagttgggtgcaagatgggagaagcagaatattcctattaactatgatcgaaataaattacgtcttgataaagcagtaggttctaaagttcgtcaaccggatttatctatttataaagaacatgctttatcttactcagggactattatgtgggattttcatccggattatcgactgtctatcataggatcgcataatgaaagaatgccatcaccgatggaactgtattatcatggcaaacatttggcaacaaattcttttcaatacggtaagaatgatttgaaaaaagagcggtcgaataatgcagaaattggtctgatgcgtatttctgataaatgggattttaaagtcagtgcttattaccaacgctttaagaattatatccacaatgagaatttgcatcgtgagggcaacttatttatgcgtcgatataacgaatcacaggcaagattctatggcgttgagggcgaaatcggttatcagataacgcctaatcataaaattacgttttttggtgactatgtgaatggaaggctatcaggctttaagaatttctatggtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattggctagcaaaccattaaacgtcctgatcgaaatgccgctcgtgttccaccaatgcgtttagggtttcgtttaaatagtcagtttaatgatcattggtccgcttcattggaatatacaagaatgtttgcacagaagagcgtttcaattaatacagtcattaaaacgattgatcgtgaggcagcagagaagcgaagagaaaatgcgaaagggcttgggattgatgagcattatcccgaacaagtccccgaagatgttacccaaggctatcacttgctgaatcttaccctgaattaccaacgtaaaataagtggagtagaatatagtgcgacactaagtgcgaataatttactgaatcaaaaaatctatattcataactcctacttgccttatgtaccgcaaatgggcagaaattttattttgaatgtcggggtaacattctagttgttcgtgaggatatcaaagagcggttgttttttgcaaaataaccgcagtatgttttctttaacgaaacctgttatctttttccaaaagttacttgataagtgcggtgctattgtgctaaactctgcgacctgtttaccatagggtagatgggttcgtcccgaaagggtgttttttattttaacggagcactaatatgatccaagaacagactatgctggatgttgctgataattcaggggctcgtagcgtaatgtgtatcaaggttctaggtggatcgcaccgtcgttacgctgctatcggtgatatcatcaaagttactgtgaaagaagcaattccacgcggtaaagttaaaaaaggtgatgtgttaaaagcagttgttgtgcgcaccaagaagggtgttcgtcgcccagatggtgcagttattcgtttcgatggtaatgcttgtgtgattttgaacaataacactgagcaaccaatcggtactcgtatttttggaccggtgactcgtgaacttcgttctgagaagtttatgaaaatcatctctttagctccagaagtactataaggagaaaatgtaatggctgcaaaaatccgtcaaaacgatgaagtaattgttcttgcaggtaaagacaagggcaaacgtggtaaggtaactaaagtgttaccaaacggtaaagtttttgttgagggtgttaatattatcactaagcacgaaaaaccagttcctgctttaggtaaagctggtgggttagtgaaaaaggaagcggcaattgatgtatcaaacgttgcaatctttaatccgacaacaaataaagctgaccgtgtaggttttagaattgaagatggtaagaaagtacgcttcttcaaatctaataatgaaattatttaaataactggagtaatgtgatggcgaaactgcatgattactacagagatacggtagtcaatgaattaaaagcaaaattcaactactcatctgtcatgcaagtcccacgaatcgaaaagattaccctgaatatgggagtgggtgaagcattgaccgacaaaaagttgctagataacgcagtagcggatttagcagcaatcagtggtcaaaaacctttagtaactaaggctcgcaaatctgttgcaggctttaaaatccgtcaagggtatccaatcggttgtaaagtaaccctacgtggtgaacgtatgtgggaattctttgaaagattgattactatcgctgttccacgtatccgtgacttccgtggtttaaacaccaagtcatttgatggtcgtggtaattacagcatgggtgttcgtgaacaaatcattttccctgaaatcgactacgataaagtagatcgtgtgcgtggtttagatattactattaccacaacagcgaaaagtgatgaagaaggtcaagcgttattagcggctttcaattttccattccgtaaataaggtaggttatcgtggcaaaacaatcaatgatcgcacgcgatgtaaaacgtgctaaattagctgataaattctacgaaaaacgtgaagaactaaagaaagtcatttctgatgtaaatacatctgatgaagaacgttgggctgcagtgttgaagttacaaacgcttccacgtgattctagtccagttcgtcagcgtaatcgttgccgtcaaactggtcgtcctcacggagttcttcgtaagtttggtttaagccgtattaaggttcgtgaagctgctatgcgtggcgaaataccaggtcttaagaaagcaagttggtaatttaccactttattttggaatcggagtaaaagcacaatgagtatgcaagatccaatcgcagatatgttgactcgtattcgtaacggtcaagctgcgaataaagttgcgattagtatgccttcatccaagctaaaagtggctattgccaatgtattagcggaagaaggttatattgctaacgttaaagtttcggaaggcgttaagcctgaattggaaattacattaaaatatttccaaggaaaaccggttgtagaaagtattcagcgcgtaagccgccctggccttcgtatttacaaacgtaaaaacgaattgccaaaagtgatgggcggattgggtgttgctgttgtatctacatctaaaggtattatgactgaccgtaaagctcgtcaagcgggcttgggcggtgagataatctgttacgtagcttaagaagagaggtaggaaaatgtctcgtgttgcaaaagcacctgttagtattcctgccggcgttgaggtaaaacttgacggtcagctactaacagtaaaaggtaaaaatggtgagttatctcacaccattcataactcagttgaagttaaacaagataataatcaattaacattctctcctcgtgtaggtattgctaatgctgatgcacaatcaggcacagcacgtgcattggtcaatgcgatggttatcggtgttaatgaaggttttactaaaaagttacagttggtgggtgttggttatagagcacaaatgaaaggcaatgtacttgtgctaagtttaggcttttcacatcctattgaccatgtgttaccagctggtgtaactgctgaatgtccatcacaaacagaaattgttctgaagagtgctgacaagcaattgattggtcaggttgcagctgatattcgcgcttatcgccgtcctgagccttacaaaggtaaaggggtacgttatgctgatgaagttgtacgtatgaaagaggccaagaagaaataattaaggtaacactatggataagaaatcagctcgtatccgtcgtgcagctcgtgcacgtcatatgatgagagagcaaggtgtaattcgtttagttattcaccgcacttcgcgtcatatttatgcacaagttattgcaccaaacggttcagaagtgcttgctactgcctctacagttgagaaagcaattagtgagcaagttaaatatactggaaataaagatgcagcggcagtggttggtaaaattgttgctgagcgtgcattagaaaaaggtatcaaaagtgttgcttttgatcgttccggttttaagtatcatggtcgtgtccagtctttagcggatgctgcccgtgaagctggtctacagttctaatagaggtaattttagatggcaagcatcgaaaaacaaactggtgaactgcaagagaagctaatcgcggtaaaccgtgtatcaaaaactgtaaaaggtggtcgtattatgagctttactgctttgacagtagtaggtgatggtaacggtcgagtaggttttggttatggtaaagcgcgcgaagttccggcagctatccaaaaagcgatggaaaaagcacgtcgcaatatgattactgtggctttaaatgaaggcacattacagcatccaattaaaggttctcacactggttctcgcgtatttatgcaaccagcaagtgaaggtacgggtatcatcgctggtggtgctatgcgtgctgtattggaggttgcgggtgttcgtaacgttctttctaaagcatatggttcaaccaacccaattaacgttgttcgtgcaactattgatgcattagcaaatatgaaatcaccagaaatggttgctgccaaacgtggcaaaaccgttgatgaaatcttggggtaattgatgatggcaaaaactattaaagtaacacaagttcgtagttctattgctcgtttaccaaaacacaaagctactttacgtgggctaggtcttcgccgtattaatcatactgttgagttaattgatactccggctatacgcggtatgattaaccaagtttcatatatggtcaaagtggaggagtaagagaatgcgtttaaatactctatctccggctgaaggtgctaagcacaatgcgaaacgcctaggtcgtggtattggttctggtttaggtaaaacaagtggtcgtggtcataagggtcagaaagctcgtactggtggcggtgttcgtcgtgggttcgagggtggtcaaatgcctttgtatcgtcgattaccgaaatttggttttacttcaatgaaatcagctgtaacagcagaagttcgtttgaacgacttagccaaagtagaaggtaatattattactttagatacattaaaagcagcgaatgttttaacaaaggatatccgctttgcgaaagtaatccttgctggtgaagttaaaactgcggtaaccattcgtggtttaggtgtaactaaaggtgcaaaagtagctattgaagctgctggcggttcaattgaggaataattaacaaatggctaagcaaccaggttatcaaaatagaagtactcaaagcggtactagtgaactaaaaagcagattattatttgtgctaggtgcactgattgttttccgtattggttctttcattccggttcctggtattgatgcggccgtgctggctcaattacttgaacaacaaaaaggcactatcattgatatgttcaatatgttctctggtggtgcgttgagtcgtgcgtcaatttttgcattaggtatcatgccttatatttcagcatcgattattattcaattattgaccacggttcatcctgctttagcagagttgaagaaagagggagaagcgggaagacgtaaaattagtaagtatacacgttattctactctcgtattagcaactattcaggcaatcggtatttctactggtctacctaatatgctacctgggttagttcctaatttaggctttggtttctattttacagcggtaattagtcttgtaacaggaaccatgtttctaatgtggttaggtgaacaaattacggagcgtggaataggtaatggcatttctttaattatttttgcaggtattgttgcagggttgccttcagcaattggtcaaactattgagcaagctcgtcaagggcaaatgcatctattagttcttttattgatcgcagtaattgtttttgcggtgacttattttgttgttttctttgaaagaggacaaagaagaattaaagtcgagtatgcaaaacgtcaacaaggtcgtcagatagtaggtggtcattcaactcatctaccattaaaagtaaatatggcaggagttattccggcaatttttgcttcaagtattattctttttcctgccacgttaacatcttggtttggacaaggttctaatttggaatggttaactgaattatcgctattattacatccaggacagcctttatatctgattgtttatgctgtggctattatattttttagtttcttttataccgcaatgcaatataatccgcgtgatacagcagataatttgaaaaagtctggcgcatttatacccggaattagaccaggtgaacaaacatcgcgttatattgataaaattatgactcgccttacattaattggtggattatatattacgtttgtatgtttagttccttatattatgacatcagcttggaatgttcagttttattttggtggaacgtctttgttgattgttgtagttgtaattatggatttcatcgtacagattcaaagtcatttaatgtcaactaaatatgaatctgcgttgaaaaaagcaaaccttaaaggttttggacaataaatgtccatatagtaaaaaggataagtaatgaaagttcgtgcttcagtcaagaaaatgtgtcgtaactgtaaaattgttaaacgtgaaggtgttgttcgtgtattatgtagcgaccctaagcataaacagcgtcaaggttaattgatatttttcttgcaaagaaccagctgggtatatataatactcagctcatttatgtccttgatatgctgtttgagtatcctgaaacgggcttttcaagatcagtatatcaaatttaatcaataaaataataggagtgcatagtggcccgtattgcaggcattaacattcctgatcaaaaacatactgtaatcgctttaactgcaatttacggtatcggtaagactcgagctaaggcaatttgtgcagctgcgggtattgctgaagatgtaaagatcagagaattgtctgaagagcagattgataaactgcgtgacgaagttggtaaatttaccgttgaaggtgacttacgtcgtgaagtaacacttaacattaaacgcctattagatttaggttgctatcgtggtttacgtcatcgtcgtggtttaccagtacgtggtcaacgtactaaaactaatgcgcgtacccgtaagggtccacgtaagccgatcaaaaaatagtcggggtaaggttaaatggctaaaacaccagttcgtgcacgtaaacgtgtaaaaaaacaagttgtagatggcgttgctcatattcacgcatctttcaataatacaatcgttacaattactgaccgtcaagggaatgctctagcatgggcaactgcaggtggttcaggtttccgtggttctcgtaaatctaccccgtttgctgcacaagttgcggcagaacgttgtgccgaagttgtaaaagaattcggtttaaagaacttggaagttatggttaaggggccgggtcctggtcgtgaatcaacaatccgtgctttaaatgcagcgggatttcgtatcacgaatattacagatgtgactccgattccacataacggttgtcgtccaccgaagaaacgtcgtgtttaatgacgtcataggatagttggagaaagaaaatggcaagatatttgggtcctaagctcaagctaagtcgccgtgaaggcactgacttattccttaagtctggtgtgcgtgctattgatacaaaatgtaaaattgatacagcacctggtcagcatggtgctcgtaaaccgcgtttgtcagattatggtagtcaattacgtgaaaagcaaaaagttcgccgtatttacggtattttagaacgtcaattccgtaactattataaagaagcaaaccgcttaaaaggtaatactggggagaatttactggtattattggaaggacgattggataacgttgtttatcgcatgggctttgctgcaactcgtgctgaggctcgtcaattagtgagtcataaagcgattgttgtaaatggtcgtgtagttaatatcccatctttccaagtttcagttaatgatgttgttgctgttcgtgaaaaatctaaaaagcaagcacgtattaaagcatcattagaattagcagagcagagagaaaaaccaacttggttggaagtcgaagcagctaaaatggaaggtgtgttcaaacgtgttcctgagcgttctgatttatcagcagacattaacgaacatctgatcgtagagctttactctaaataatagttaaggctttgtagcaaagagaggataaaatgcagggttctgttacagaatttttaaagccacgtttagttgatattgagcaaattagttctactcatgctaaagtgatcttagaaccgttagagcgtggctttggtcatactctaggtaatgcattgcgtcgaattcttctatcttctatgccgggctatgcagttaccgaggtggaaatagatggcgtattgcatgaatatagtagtaaggaaggtgttcaggaggatattattgaggtacttctgaacttaaaaggtctagcggttaaagtacagaataaggataatgtttttctgacactaagcaaatctggaattggccctgttgttgcagctgacattactcatgatggtgatgttgaaatcgtaaatcctgatcatgttatctgccacttaacagacgaaaatgcgtctattaatatgcgtattcgtgtacaacgtggtagagggtatgtgccggcatcatctagagttcattctttagatgaagaacgtccgattggtcgtttgttagttgatgcttgttatagtccagttgatcgtattgcttataatgtacaagcagcacgtgttgaacaacgaactgacttagataagttggtcattgaactggaaacaaatggcacaatcgagccaaaggaagcgatccgtcgtgctgcaacgattttagcagagcaactagatgcctttgttgatttgcgagatgttcgtcaaccagaagttaaggaagaaaaaccggagtttgatccgattttattgcgtcctgttgatgacttagagttgacagttcgttctgctaactgtttgaaagcagaaacaattcattatatcggtgatttggtacagcgtactgaagttgagttactgaaaacacctaatttaggtaaaaaatctcttacagagattaaagatgtgcttgtttcacgcggtctatcacttggtatgcgcctcgaaaattggccaccagcaagtattgctgaagactagtttggtcataggttaaagatttttctgagaaggataaggtcatgcgtcatcgtaagagtggacgtcaactaaatcgtaatagtagccatcgtcaggcactattccgtaatttagctagtgcattggttagtcacgaaattatcaaaactaccttgcctaaagcaaaagaattacgtcgtgtagttgaaccgttaattacattagcgaaagtagatagtgttgcaaaccgccgtttagcttttgctcgtacacgcaacatcgagacagttgcgaaattatttaatgaattaggtccacgttttgcacaacgtgcgggtggttatactcgtattttgaaatgtggtttccgtgctggtgataatgctccaatggcgtacattgagttagttgatcgtccagccttagctgaagaagctaaaacagagtaatttataactcatttaaaaagcccacagtaaaatgtgggctttttgtagtaatcatatttactttctattctattccctatcatcaattcctatcaataaaaaatttccgtttatattacataaacttctgaatccaacattggtaattttgaagggatttttatttggacgttttgtgtagtcaaagctatcatggtgatgaccgtgaaaaatatgctttacttgcattgatgtggctaaattattaataacagaaaatcctaaaggatgaggttttggtgcctcatgacatattagtatgtctgctttttgtttttctaatgcttcaatatcagaaggaaagattgaagttctatgacgcaatggaatacctcctcgccaaattttttccggaggagcgtattggcaatagtggatatgatcaaaaaagagcggtttatttggtggcatccaaatttgcccacgaaacacgcctcctaatccggcaatttttattccttgaatgtcgacaactttaccgtgtaaattacgtgatttccattttataccccataaggcctcatatgctgaaactgttttgctatcatgatttccatggataaaccaaagatcacaaaactgtgccagtttatccagttcatcagaagtagttaattgtaaatcacctaaaataataagagatacatttgcatgttcttgaataaaagggtaaagatgggaataacttccatgtggatcaccggcaaataaaatcataatattattccttaaaaattggaggtgtgattgtttccacggctaagtccaaaagttcttcgttaagtactttttcaacaatatttttcacttgattataacgttccaagtaactgggtgagtcaatttcaatataaggtacactatgcttatctaataatttttttaagagttgttggaagcgttgacgttgtttagcatttcctaagctacgcaagccatcatctacccattgggtattattatttaataaaatggtcacatcaaaaggatattctttgatcatggagtctaagaaagggtgtgcttttccttcatactgaatacaaaatgcctgagttgtaataaagtctgtatctacaattgcaactttgtgtgcatgcctgacggcataatcaatataacgctgatgacctaatgctatttgtggataatcagaatattgcatagcttgttcattaccccccagtttttcaaaaacaaactcacgtccatattcccaagctgatgtagtattaaatactgtagctagcttattaacaagagttgttttaccgctactttctccacctaaaatagcaattgtttttgcaaaaaatgggcgaacttctttaggaatgaatttccaatagtgaaatggattgttacgaatttttgttgcagaaatattaaggaatcggcgttttggatcaactaattcgacttgtaaatttaaatatttttcataaggtactttatcttggatttcactgctaaaaaccacgctaggattaacgtttttttccttgaatagacgttttacttgttcagcccatgcagaccagccattgggataacttggtagaccatcttcaataagatgatgaataacaattttatttttctgatatttaaaaatctgttgcatccaacgtaagcgatcctgtacagttggcattcgtttcattttactgtcataaaatagttttaaatctcgttctgtatcgctacatacaaccacatgaagctcatctactttgctaaatgcttcataaatcatattaatatgaccggtatgaacgggataaaatttgccgaaaataacgcctatttttttgttatcttgttcagtgatctgtagtgctttatgcaatgctgaaagttttgtggcacttggatttttaatttttccactcactaattggttaaaataagcacgagtgatattggcttgtgtacaaagctcattaaccttcagatttaattgcttacgtttttgttgcagatagctgaaactcgacattattttctccttttctatttagggaatatttaatgagtagcataaaaagtgcggtaatcacttagtaagttttttatttttcttgtaattgttctaaacgtttctctagttcaatcagcttttcacgagttcttattaaaacttgtgtttgcacatcaaattcttctcttgtcactatatctagtttagataattgagattgtaagacttgttttagtttcatttcggcatcttgccctaagtcttttacaccttgtgggagagaatcttgaatttgttgcataatttgttctatttttttaggatttagcataataagctccattttgatataaattgccccattgtatgcaatcttattcaaaataaaaacattttttcttattaaacgttaagatatactatacgtgcattctcagggcagggtgaaactccctaccggtggtaaatatttcgatataagcccacgagcacttacttatcttagtaaggtcagcagatttggtgaaaatccaaagccgacagtgatagtctggatgaaagagaatagagcgaggtattatacttatcgttgttgtttttctatttatctgatagaaaaaatccttttatcatcagccctgattctagtatctattaatttatttaaaggagtttactatgaatcagtcattattatctcagtttggtacatctgaagaacgagttaaacgtgcgattgaagctttcaaaagagggaacggagttcttgtccttgatgacgaagatcgggaaaatgagggtgatcttatttttccggctgaaacaatcacagttgaacagatggcaaaattaattcgttatgggagcggaattgtttgcttatgtatcactgatgaactttgccaacagctcgatttgtcaccgatggtacaaaataacacaagtattaatcaaacagcgtttactgtgagtattgaagcggcacaaggtgtatctaccggcgtatctgcacaagatcgtgtaacgactattcaagtcgccattgctgataatgctaagccgcaagaccttagccgtccgggacatgtatttccattaagggctaaaaagggcggtgtgttagcacggcggggacatactgaagccgcagttgatctagcttcttgggcaggtcataagcctgccggggtaatttgtgaaataaccaatgatgatgggagcatggcaagaacactggagatcgtagaatttggcaaaaaatttaattacccagtggtaacaattgaggatcttgtccgctattcatcaagcaaagttgtttagctcgataagtaagagcatcatcaattttttttcgttgttgatgctgtaattaaattgaaatttccctgttcccaacagtttgggtttctgtaaataaaaataaaatgaagactatgcaagatgaaaaatctgttaaactgtgtgctatttaaaatgggttaaaggataaaattattagtaaattaaaacgtgggtttgtcttacatcgacgggattatagtgaaaccagtttgttggtcgagttattcactgaagaacacggacgtttaacagtattggcgaaaggggctcgtgcgaaacgatcggcgtggaaatctttgctacaaccctttacacctttgttacttaattggtctggtcgtggggaattaaaaatattaataaaagcagaggcgatatcattaactttaccgctacaaaccaccgcactttatagtggattttatgttaatgaattaattgctcgtctattggctccggaaaccgcatatccggatctttttcaatattatttgcaatgcttaactgcattggcaagctcaccgcaagaaatcgaaaaaagtttacgcacttttgaatttcaactgttggaagttttaggctatgctgtggatttttgtcattgtgccggttcggggcaaccggtcgatgaaaatatgacctatcgttatcgagaagaaaaaggttttattgcttccttaattaaggataatctgactttttatggacgtgaattattagcttttgagcgtagagaattcgtcgataagaccgtcttgcaggcggcgaaacgttttagccgtattgctttaaaatattatttgggtaataaacctttaaaaagtcgtgaattatttacgcagaatattttacatacaaaataagttttactagatataaatttatggttttactttatcagccaaagaaacaaaaaaaattgagagcagcttttacgaccattgttcaagatttggattatcaaggattaggtgtagcaaaaattcaaggaaaaacgtggtttattgagaacgcattaccacaagagcaagtacaggttcaagttattgaagaaaaacgtcaatatggactgggtcgagttcaaaagattttacaagccagccctttgcgacaaactccaagatgtgcttattatcaaatttgtggcggctgtcaatctcagcatatccctatacatttacaacgtgaaacgaaacaaaaagcgttatttcagcgtttaaccaaactgcaaaaagaggctatagaatttatgccgatgataagtggcgaagcatggcattatcgccgtagagtacgcttaagtttgtactgggacgctaaaagtaaaaaattgaagataggctttcggcaaaaaaattcacaacaaatcgtgaatattcgtcaatgcgatgtgcttgatcccttgttaaatgagttattacctaaattgcatgagttgttgagtacgtggtttaaaccgaaaacactaggacatattgaattagttgccgcagataatggcgtagcgatgttattgagagtaacagaaaaattggctgaacatgaccgcactttattgttggattttgcatttaatcatcaagtgatgttatttgtacaagatgaaaaagagatttgtcatttgcaaggagatttgccttattaccaattagatgatggttctattttacattttgatattcgtgattttattcaggttaatcgccaacttaaccaaaacatggtcaatactgcactggattggttggatttgaagaagaaggataatgtgttggatttattttgtggtatgggaaattttaccttgccgattagccgatatgtgaaaagtgcggtaggaattgagggtgttttacctatggtcgaaaaagcccgtcgtaatggggaacgaaatcattgtcataatgtccaattctaccagtgcgatttaagtcaatcttttactgagcaagaatgggcaaaggttccttttgacaaaatcttactggatccgccgagaagcggtgccgcatttgctttaaatgcattgtgttatttaatggctgaaaaaatattgtatgtgtcttgtaatccggcgacattagtgcgtgatgtggagcttttgcttaagtttggttatcaattaaaaaaagttgcaatgattgatatgttcccacatacaagtcatctggaaagtattagcttatttgaaaggaacagataggaagtaaagttatggttgcagtgcgtggttcacatttacttaatttgcaagattttgtggttgagcaatggagtaaaagtttatctttacctgagaatgttgaacaaaaattaatacaggcttggcgttatgcacagcaaaagtgtcttattgtacaaagtgaatcggagaaaaaaattgtttgttctctgcaagctggtgtggaaatggtggaaattctgcatagtttgaatatggatgcggaaagtttgattactgcaatgctttatccattggtgaaccataaaatgacttcccttatgcaaatcaaagaagattttggcagtaatattagcaagttagtgaaaggcgtagtggaaatggataacattcgccaacttaatgctagtcattcagccaacagtttgcaggtggataatgttcgtcgtatgttattagctatggtagatgattttcgttgtgtcatcattaaacttgcggaacgtattagctatttacgggatgtagaccgcttgtattctgaagaagaaaaagtactggctgcaaaagaatgttctaatatttatgcaccgcttgcgaaccgtttgggtattggtcaattgaaatgggaattagaggattattgtttccgcactttacaccccgatacttaccatgcgattgcaaacttattaaaagaacgtcgtttggaccgagaacaatatatcgcggattttgtgcaggagttacgtggttatctgaatgagaatttggatcaagtagaagtgtatggacgaccaaaacatatttacagtatttggcgtaaaatgcagaaaaaacacttggaatttagtgatttatatgatgtaagagcggtcagaattattgtacaaaaattgcaagactgttattccgctttgggcattgtacatactcatttcaaacatttgcctaaagagtttgatgattatgttgctaacccgaaaccgaacggttatcaatctattcatactgtcgtgttgggcaaaggtggaaagcctattgaagtgcaaattcgtactcaacaaatgcatgatgatgcagaattaggtgttgctgcacattggaaatataaagagggtgtaagtggaggacgttccggctatgaagaaaaaattgcatggttacgcaaattattagcttggcaagatgatattacggattccggtgaagtcatggcggaaatgcgtagtcaagtttttgatgatcgtgtttatgtcttcacgccaaaaggcgaagttgtggatttaccaacaggatctacccccttggattttgcgtatgctattcatagtgaaattgggcatcgttgtattggtgcgaaagttggtgggcgtattgtaccttttacttatcagcttcaaatgggtgatcaaattgagattattactcagaaaaccccgaatccaagccgtgattgggtaaatccgaacttaggttttacgcacacggcgaaagcacgtgctaaaattcagaactggtttaaaaaacaagatcgcgataaaaatattcctgccggaaaagaattgcttgaagttgaaatagcccgtttaggtatttccttaaagcaggtagagcaacacggattgcctcgctataacctgaagaatttagaagacttgtatgccggtattggtggtggagatattcgtctaaatcaacttattaactttttacaaaataaattaattaaggtgagtgcacaacaaacagatgaagaaattttgcgttatgtagccaataaaggtgctcattatgtgagtcaaaaacaaaaaacagagaaaaaaggttacgtgattgttgagggggtaggtaacttaatgtaccatattgcccgttgctgccaacctattccaggtgatgatattatgggctatatcacaatgggaagagggatttctattcaccgtggcgattgtgaacagtttatagagttgcaaaatacacaccctgaacgtgttgttgagtcagtttggggcgaaaattatgccacaggtttccgtatcagtattcgtattatcgccagtgatcgaaacggtttattgcgagatattacaacagtattagctaatgaaaaaattagtgttttgggtgtatcaagccgtgcagatacgaaaaaacaacttgcgactattaatatggaaattgaattaaataatgtacaaattttaagtaaaattttagcaagattagcgaaattagatgacataattgaggcaaaacgtctttagataagttaggcaaaggtaaaggtaaagataatgaaaaaaacaaccggattggagcattttataaaatcaatagtctattccttaaaagggttgaaaagcacgattcaacatgaaagtgcttttcgtcatgagcttgtggtttgttgtattttatttcctttagcgtttcattttgcacaaagcaaaattgagtttgtgcttatgattggttctttattattggtgctggttaccgaattgttgaatagtgcaattgaagttgtggttgatcgtattggaacggaatatcatgagttatccggacgagccaaagaccaaggctcagcagcagtttttgtcgccataatccttgcactatttacttggggagtgattttattttgttagcgtgttgacgtccgccctgccttcaggcagggcggatgtcaatagactagaaacgaacttccacggaagcggcaaaattgcgttttggtgcggtaaaacgattgatgccttcccctttaagtcctacagaacgagcgttataacctctggtaaaccataagttataggcactgtcccaagttgtataattacggttgaataagttaaaaatccccatatttaatgtaacatttttactcaggttaacttgtcccgttaaatccactacaaagtaagaaggacttaagaaaggccacggtttcacatttttagcaacatcaccacttttgttaccgccaagttcatattctgtttctatagcatctttggcttttttagccgcactgtaacgaccggttaaactgatactccatttttccgtttcataatcaattcccccaaccacggtccaaggctgaatggatttaagcggatcgccatcatgattttgccctttgctataactccccttaaggcggaatgttaatccatccgacagtcccaatgccgagccgttaacagcaccgctaacttctatccctttaattaccgctttaggctcattgacaaattgagctaacgaaataaactgtttcgaaccaccccaaaaactactaggattgtagtatggatttggcttacatctttcacgctcttggataaagttatgataacgtgtgcggaaaagcccgacgctaaaatgggcatattggttttggaaacggtaggttaattcgtggttcagtgcagtttccggttgtagaaacggatttggtttaaaattattagtagtaccactaccgtcacttacaaaatataaatcttcagcacgaggcactcgaaaaccggtgcttaggcggtagccaatttgatgtgatgggtgtacttgatattccaaccccaattgccaagacagatgggatagttttcttgaggggaagttgattttggcattattgacttgccccttgagttgaggggcgtaattataacgatcataacgtccgccaatagtggctttcaatgtatcggttaaagcgacttcatcaagcaacgatagggaaaaaatacgagattttaccggaacaacttccgtataatttgggcgattttttttcattaaatacgaactagtagagaaacgttgagaattactgttttccaaaaattgatcacgaaattccactttgctggataagcgatgcgtggttcgccataatgctaatggataagttgataattctccacgagtaatagtttgatcttgaatgtactgataggaagcaagttgaaataattgattattcctaatagtacgaagagctgaaagttgctcaattttctgttttgccacaaagagttttactgtttctaaccaatataagccattatatcgatattcgagaccataacggcggtatggtgttctgtctgtggcaaatcggttctcatcgctaatccccaatgttttttcttcggtaaatttcttttctgcacgatcttctaaaaatagtgtaaagcgatgggtgttattaatatcgtagccgatttttgttaaccatgaggtggtgtggtagctgagggggttgggtttgccacgacccggaccagtaatatccgcacctttgccattattgattgtttcatgcccccaacgtttggttaattgtgcaaaaccgaagaagcgatcagtcttgaaccccccccctatcacttgacgccattctctattttttgaggtataaccggttttggataagaagccgaaagtgcggtcaggttcgacaaaatcttcaatctctttggtggtaaaagaaaccgcaccccctaaagcaccgctaccattcatgacagaatttgcccctttctgtacttttaccgagctaatattttcatattccgtattattgatattgccattgtgacgttcggtagaataacgtgcggaagtggacattgttgattcggcttgcggtataccatcaacaatcaccgcaacgcgatctttgtcgacaccacgtattgcaaagccgttactaccggaacgaccgccttcaggcacgccaatccccacttcatgacgaaataaatcacgttcattagacaccatatttttccgcaattgttcggaagattgagtagaggaaaaaataggctcaacattcgccacaacggatatttcacccaattcttccgctttgtggggttttgtttttgctggattcgaatcggcaaaacttaatgcaggaaacatcaagctacttgaaagaaataattggttgagaataatagaatacttagatttcaaaatgaaaatctccctgtaaaaaatataatagaaatgagaatggttcttataattataaatgccctaactgtcaagttttttaatcatttttatggaaagagtaagttatttgaataaactatattgttgctaaacaaaacgttgcttgtgaaatgtatttttcactagcatttttaccaagagtttttgtattatatgagcaaaataagtatgccttgattcatatagatataaaagagttgttaaatattaatgcgataggatatgttaaaaaaattaattttacttgtcatcccgatgttgctaacggcttgtgcatcttcgttaaaagtgcttgaactgccgcaagtaaaaacagacagcagactttttgtgattacacaacaatttcctcaatcggaaaaaagtttgctggcgattgaagttcaacctcatcaatggcgttgggtgcaaacagatccgctcggtgcacctattgctcgtcttgttttgagtaaagcggggtggcaaaacgacggtttcgttatgccgaataagcaggcaaaacagcttttttctgcgattgcgacgtattttatgtcgactatgattttcgatgtccagcagatctcggaaaatgaatatgcacaaaaccatcggttaatatggcgattttctccgcaaaaacacggcgttaatattgagttgggggataagtctgtttggtttgtcgaacctttgagactgaattaaaattgtactaattatcagaaaataaaatgacggaaaccttatatttatcaaaacctgcgataatcagtgctatgggcgaagggctgaaaacgcatatagaaatgttattgaatgcggagcattccccgttagtgcattccgataaggtgtttagtcggcatcacattgccggtaaaatcggtgtcttcggcgagataaatttatcattacgcccatttccggacaagcttagtgtacaacaccgtagtcgtaataatcaggtattgtggcacgcattggcagatattgaaccgcaaattgagcaagctgttcagcagtttggcaagcaacgtatcgctgtggttattggtagttcaacaacgggtgtagatgaaaatattcctgttttcaaaggtggagcaagccaacaagattggtcgttagcacctttcaattttcagcaagtttcattttccgctccagcagattttgtggcggaagtttatggtttaagcggtttagtctatggtatttctactgcctgtacttcgggtgcaagagcgttaatcagtgcggctcggttattgaaaaataatttgtgtgatgcggtaatttgtggtggtgtagatacgctttcaccgctaacggtgagcgggttcaattctttatccgtgctttctgcacagcgtacaaatccgttttctcgttatcgcaacgggataaatattggtgaaggtgcggcggtctttttaatgacgaaaacaaagttaaatgatgaaagcctacaattgttcggctatgggtcgagtagtgatgcttatcatatgtcttccccgcatcctgaaggcgagggagcaatttccgcttttgagaatgctttaaaaaacgccaatgttaaggctgaacaggttggttggattaatttgcatggtactggcacggttcaaaatgatcacatggaaagccttgcggttgaaaagatcttcggagataagaccacttgtaccacaactaaggtatatactggacatacgctgggtgcggcaggtgctattgaagcggcgattttgtggggtatgatcagtcgagattataatccaacgggtaaacttcccgcacaattgtgggatcaagaaaaagatgaaaatctgcccgcacttgcgattacagatcgggatagttattggaaaatggatagacgtattggtgtaagcagttcttttgcctttggcgggaataattcggttttggtgttgggggagtagcatggttaatttgcattgtccgattacgcaagtggctcccttgctgccgcatagtaacgatatggtgttgcttgatcttattacggattttggcgaagattttttgatcgctgaggcaaggattaaaagcgataatattcttattcgagaaggtaaactcagtgcattttccggtattgaaattatggctcaaggtgtggctgcttgggcgggatgtatggctgttcaagccaatgagccagtgcgtttagggtatttactcggcacgcgtaaattacatatttaccaagatgagattgcgatcggtagccgtcttcagattaaaataaacatgtccattcaagatgcgacggggtttggtgtatttgattgtcagcttattgatttagccgataatcatgtgattttggaaggggcattgaatgtgtttagtcctaaggaggaacaacaataatggcaaatacagtgcttattaccggctcaagtcgcggtattggcaaagcgattgctttaaaccttgccacacaggggtatgatattgtggtgcattgtcgttctcgtatagcggaggcggagaatgtggcacaagaggtgagagctttagggcaaaatgcaagagtactccaatttgatgtggctgatcgtgaaaaagtgcggtcaattttagaggcggatgtagaagaaaatggtgcgtattacggcatagtacttaatgcagggctaacccgtgataatgcttttccggcattgaccgatgatgattgggatagcgtgttacgcaccaatttagatggtttctataatgtgttacacccgattatgatgccgatgatccgtcgtcgtcaagcggggcgaattgtgtgtattacgtctgtttcaggcttgattggtaaccgtggacaggtgaattacagtgcgtctaaagcggggcttatcggtgcggtcaaggcgttggctattgagttggcaaaacgtaaaatcacggtaaattgtgtggctccggggttaattgacacggatattctggacgaaaatgtcccgatagatgagattttaaaaatgatccctgccggacgcatgggcgatcctgaagaagtcgctcatgccgtgcaatttttaatggatgaaaaagccgcttatattacccgtcaagtgattgcagtgaatggcgggctttgttaaagagcggtaaggatttcaatatttttattcacaattgaacattaacagcaaaaaggatacgaagtgaaacgggtggtagtcacaggaattggcggtatcactgcttttgggaatgattggcagaagataaaaacagcttttcaacgtaaacaaaatgccgtcaaatctatgaatgattgggttgaacgttttcccgaattggatgctcgtttaggtgcggttattgaggattactatcctccgaaacattggaaccgtaagcaattacgcagtttagggcgtgtttctcagctcgtagttgatgccagtgagcgagccttggctaacgcttctttattggacgaagacggtattattttagaatatctgaaagacggtagaatgggtgtagcttgcggttcttctaccggttctaccgatgatattaaagatgcggcggaacttttgatgacaggtaagtcagatggtttcaatgctaacacttatgtacgtatgatgccacataccactgcggcaaatatcggcattttctttggcttaacagggcggattattcccacttcaagtgcttgttcatcaggtagtcaggcgatcggctattcctatgaagccattaaatacggattgattcctatgatgcttgctggcggtggtgaagaattttgtccgtcagaggtttatgttttcgacagcctttatgcggcaagtcgtaataatgacaatccaagccatacgccacgtccatacgataaagcacgtgacggattagtgattggcgagggcggttgtatgtttgtgttggaagagcttgagcatgcattagctcgtggagcgaatattattgccgaagtggtcggttatggtgcaaatagtgacggtagtcatgttacccgcccgcaaaaagagacgatgcagcgttgtatggaattagccctgaaagatgcagggattgaaccgagtaaaattggttatgtcagtgggcatggtaccgctaccgaacaaggcgatattgcggaaacgctggcgacagaagccgtatttgggtatgttcccatgagttctcaaaaaagttatcttggtcatacgttgggagcttgtggtgcattagaagcttggtttagcattgaaatgatgcgagatggctggtttgcaccaacgattaatcttgacaatgtagatgagcgttgtggtaaggtggattatattcaacatgatggacgagaaattcatactgattatgtcatgaacaataatttcgcatttggtggggtgaatacttctcttatttttaaacgctggacggatgaatagtggtaataagtcgctacatttcggggtgtacattatagaaattgctatggaattagctaaaattagcggcgttttgtaaagttgtggatagagaaaaagcgtatggcaaagatgataaatgatgggtgtaatatcgataatgactttgttcaaaagagtattaaacaatgacgcaacaaatctgtaatttttcatttaatcttcatgcgtggaatattgtctgtaataaagagctttccggagaggattggcaacaaggcgagcagtattggatggaaagtgttgctaaacgtgaaactgttgcaccgaaactggcttttttatcgccgttaaaacgtcggcgtttaagtgaaagtgcacgtttattttttgaggcggcatggccgttaaccgaacaagagaataatttgccggtggtgtatgcttcgctgaatggagaaatcaatcgtagctttgccttgtggcattctctcttaactgaaggagatgtgtctcctacttcatttagtctttcggtgcataatgcccttgttggacaatggtctgaaatgcgtcaggttaaaaatgaaacgacggctattaccgccttaaaagatagcttggaaattgccttattagaggcttttctactcttaaatgatggacaagaaaaggtgctggtcgtgctttcggaaacaccgttatcagtgaaatacaatgctcaacccgtggagcgtttgcctttgtcttatgcgttggcgatggtggtggaaaaaggctcgacttatcagcttagtttgcaatcgcaagtcattgacaatacggtgttttttgataatgcacttgcttgggtgcaacagcaatatttgggggcatcccaatggcaaacccaaagtagtcgtggaggaacttggttatggaagaaaaacttgattggctaaggcgttttctcggtacgttatttggttttatattgttcggtttcgtcggcgtgctgtttaaaattatcctttatccttatgcaaagcaatatcccaaggcagatttagctacgcaattaaaaggacgtaaaattgtcagtcgtacttgggcattttttgtgcgttatcttatttgggcgggtattttagaggttcgttaccatggttttgagcgattggggcgtaaaggacagttagttttagctaatcacccctctttgcttgatgtggtgctgatttttagtcaagtgccggagtttaactgcattgtgaaacaagatttgttaaaaaatcctgctatgagcagcccgataaaagcctgtggttttgtgccgaatacagaatcggaagaattattggaaatgagccatcggattttacaagaacaatccttattactttttccggaagggactcgtacaggttgggatggtgtggtgaaattacatcgcggtgcggtttctattgggttgcgtagtgcaaaagtgatcacgccggtggtgattaaaatgaccccgttaaattttaaaaaaggacaaccttggtataaaattcctaaaactaagattacgtatgaactaacagtgggcgaagatatcgatccgcaaaagtggttggcggaaaagcccttgcctattgcctctcgccgtttaaatcaatacttggaagattattttaactcacaaacaaaggactaaataatggaacttgaattacaacttaaacaattaattattgacagccttgcacttgaggatattggtgttgaggatattgacactgatgcaccattatttggtgatgatgggttgggactggattcggtggatgcgttagagctgggattggcagtccaaaaaacgtttggtttacaattggatagcgaacaacaaaacttgcgtaatcattttgaaagtgtggcgactttagcaagttttattcaaagtcagaaacagtagaggaaaagaagtgaaatgacagaacaggaaattcaaaaggtgttgacggaagccttagtttcattatttgaaattgatgcggacaaaattaagcctgaaacaaatttataccaagatttagaaattgacagcattgatgcgattgatttaattgactatatcaaacgccaaaccggttataaattaaaggcggaagatttccgcaatgtgcgtaccgtaagtgatgttattgctgcggttcaaaaaatcagcgaaaacgcatagtcaagttgttgaggttgataaaataacctttggattcaagaccttgaggggggggatagattgatgagtatagaacagcgactcatgcaaagcgagcttgtgcagaatccaatatggctgagtgagacacaagaagaaaatttgcaaatcttcagggcgaaagtaccgcttgatctgtgctatttcaaaggacattttgctaattttcctcttgtgccgggagtcgttgagttgcaatgggtgaaagagaaaatagatgcttactttggcaaagaaatgcagatgaatcgcattgataatttgaaattccaaaaatttcttcgcccaaacgatgaatttgagctcacattaaaatgggaagaaaacaaaaatcgaataggttttcagctcaaaactgagggcgaaatgtgtgccagtggtttcgtgattttcaaaaatggttaaattattcaatttattgattaacttggggttactgcttaccggcattggttatccgctggcgtggttttttgatgaaaaacaccaagggctttcgtatttagtagcaataatggcgttattatgggcaatcaaagcgataaaagcggtcagttttcatcggtttttggcaatcctaatggcgatattgcttggcatcgtttggcttactcgtagtttggaaacaatgtattggtatcctgtcatcatcagtacggcaatgcttattttatttggtggtagcttatttagctcacaatcgcttattgagcgtttcgctcgcctacaagattccaacctttctcctcaagccgttagttacacccgaaaagttaccctagtctggagtggattttttgtgctaaatattaccatttgcaccgcacttatcctcgctggacaatatcactggtgggcatggtactcaggcggagtttcctatgtactaatggggttattgatgtgcatcgagcggttggttcgacaagaggtaatcaaaaatggataagcaacataatcaagggtatgcggattttgctttgcgttgtcagcaaatacgccaacagcttgaggaagatcgggtgaaagcggtggggttatggttagataatgcagatcaatttgcctgcgtgttattggcttgtttgaatgcaaaagtcaatgtgttgttaccgccgaatttactcaatgaaaaccttgaatggttggaacaacattcagcattactctttgataaaaaaatgattgagcaatttgggcgtttgcaaaaaattcaaaaaatccaacctcttttggataagcagaatgaaagtgaaatttggttgaaaacatcaggcagcagcgggcaggcgaagatcattaaaaaaacggcaaagcagatgtggcgggaatctcaagccttagtttctgtcttgccatttaacgccaatgaacaaatttcagtcattggtagcgtcagtttgcaacatctttacggcttgactttccgtatatttttgcctttacaaatgggctggaaattaggtggtgagcagttacattaccctgaatatttactggcagaaagtcgtcattatcgcacgctttggattagtagccctgccttattgagccatctcaacttggcaagtttggaccagcatgtgcagattgcaggtatcatttcatccggcggggcgttacccgaacaaaccgcacttgctttgcgagaggaattgccttgccccgttattgaaatttacggtagtaccgaaaccggtgcgattgcttttcgtcagcaaaccggcgggctttggcaagcgatgccgaacactcggttgggattaaatgatgaagaggcgttgtgggttgaaaatgcatggattgtcggacgagagcaaacggcagatgcggtgcaatttagtgagcatgggtttgaattactgggaagaattgaccgcattatcaaattgggtgataagcgtttgtcattggtgaaaatagaacaagatttgctcaagcattgttttgtacaagattgctacattgcactacattgcctacatcagcgaccactagcttgggttgctttaaataaagaaggcattgcctattttaaacaacaaggacgtcaggcagttatttcacaatttcgccaatatttacgcctgacccaagaaaaatttgctttgcctcggtattggcgatttacggacaaattacctcgcaataaccaatcgaaaatcagccgtttagattttgaaaaaatttgtaccgcacttgagtatgaggtatttgcatgacagcgtttaatcccattgcgatcattccccattataaccattctgcaacggtaggtagcgtcgctgaacagcttaatcaactagggctacctgtattgatcgttgatgatggctcaagtctggaacataaagcagtgattgagcaatttccacaaaatgaacagctttccattttattttgtgaaatcaacggtggtaaaggtgctgcttttaaagcaggcttaaaacagacacaaaaacttggatttagccacgctattcaagtagatgcagatgggcagcataatataattgatgtcaagaaaatgctcgaacaagcggaaaaatcaccgaatgcaatagtatgtggtaaaccgatttatggcaaagatgctccaaaatctcgcttatatgggcgaaaaattaccgatttttggaatgcaatcaatacgttatcctttgatattaaagacgggatgtgtggttttcgaatttatcctattactcaaattatgcccattcttgcacaagagcaaattggtggtggtatggattttgacacagaaattttaatccatagttattggcagaaaattccgcttatttgggttgataccccagtaaaatatgaaaaagatggcatctctcattttcgtggttgggcggataactggctgctcagcaaaatgcacgcacgccttttcttccgtatgctcaaacgactctttacaggaaaaattcgatgaataaacattgggcaaaacaacaagagcgtggtactgccttttttctaaccttaactcgtttaattgtgaagtatttgccattgcccataattcgagcagtgaatttttgggtggtgttatatttttatctcacttctcggcaaaaacggtgctacattgcagaatatcagcaaaaactgaccgctctttttcctgaaactaagttacctaaatatgcggtatttagacaatttctcgcttttggcgaagccattactgatcgtttcgccgtatggcaaaaaaaaattcgttatgaacatcttatcgttgatgatgcggataatctttatgcagatatcagcggcaatggtcgaggacaaattttggtttgctctcattttggcaatattgagatctgtcgggctttgttcggtagcggacagcacgaaaattttaaactgaatgtactggtacataatcgacatgctgcagcatttaataaaacattgggtgatgcaggtgctgatgaattaccgctgattcaagtggaagacctcaatgtacaaaaaatgctggaacttgctgaaaaaattgatcgtggcgaatggattgcgattgccgccgaccgcattcccgtacgtggcgataaaacggagccagtcaattttttgggttctccagccgagtttcctcaaggtgcttggctgctggcaagtttattgaaagtgccgcttaataccatcttttgcatcaaagaacaggggcgttaccgtttgcagcttcgccgttttagtgaaagtattcaaggtcgaggaaaagtgcgtgaacagaatataagaaatgtcatgcaaaaatatgcggatttactggcaaaagaatgtgcaaaatcaccatttttgtggtttaatttctatgatttttggcatcgcaaagattaacttacttttctcaaggagattttatgaaactgatcaaaatattagctttaactttttctgcggttgtgattgttgcttgtgcacctcgtgatacaacccattatttatctattcaggaagccttaagttctcctgaggctaaaaaaatactgaatcctaaaatcaagctttattttggtaaacctgcaccgggtcaagtgattcaaaaaggggcggttaccaacccgaaaacgaatgcggtgaataaaacagataaagaagcgtgccaatgggtattcttatctgcagtgaaacgtttccaagatcaagcggtagctaaaggggtaactaaagtgggtaacctcgtgagttattacaagaaaaaagaatatagtagtaccactaaatatgagtgccatgccggtagaagtattgctggtgtagcattaaaaggcgattttgttaagtaaagctattaataatctaggataaacaagcggtttaatttcttgaaaaaatgagcaaaattaaaccgctcttttgcttaaaatgagacttaaaaaacacatttacgctgaacatttttccgactatgaaatcccattttttgatgtggactccatgtttattatgtggcatggtcattatgtcaaatatttagaaatggctcgctgtgcatttttagaagaaattcactatacctacgatgtgatgcgagaaaaaggttacggctggccaattgttcaacttcatttgaaatatgttaaacctgccgtatttcgccaaaaaattcgggtgcatttagctgttgtagaatacgaaagctgtatccgtattgattacaccattactgatttagccaccaaacaaaaactgacaaagggtagtaccacccaagttgccgttgatatttcaaccggtgaaatgcaattacaaacgccacaatcttggcgtgatgcgatagaaagctatcatgggtttattgctgagtgagagagcgttaatgaaaaaatatctttttgtcttgttaatattattatgttgcaaaaatctttgggctttttctcaggatgatttagtacatttgttacaaaagccacagaatacgcaaggtgaatttagtcaacaacgttatttaaaagccttaaccaaacccattatcacttcaggaaaatttattttaataaaaaataaagggttggtttgggaaacggaaaaaccgtttacacatcaattgaaagtgacggcaaaaggcattagccaatggaatggaacagcatgggaaaaccattctcgtttaggtcagggtgagcaaattaaactattcttaggcttattgtccggcgatattcaagcacttgcgacacaatttgacgtagtgctttcaggagatgaaaaaaattggcaacttcagctcatgcccagcagtttgctgatgaaacaaatttttaatcaaattattattcagggcaatgtagctgtgcaacgtattgaattgcatgaaaaacagggagatcgtaccttgattttgtttaataatcagcagattaaccttccattatcaccctttattcaatctgccttccaataggaatttgcatgcgcaaattattgaccgtttaccgcttaatttttgccggggttttatgtcttgtggtggcgatttttatgtatcatttacaaacaggtaaatggttacaaacggatctacatacacttttgccggacagtcaacactatacaaaaattcaattagaggcagataaacatcaagaacagcaatttaatcagcaagttattgcattggttggacattcacaatcagaagctgcttttaaattgacggaaaaagttgcagaacaatggcaaaaaagtgggttatttcaaacgttatctgtaaaaaatcaaccgaatttagctgaacttcaacagcagattgagttattaaaattagccacactgcctatttcaacacgaaatcagattattcaacagcccgaacgttattttcagcaatatgcagagcaaatcattaacccgttcggttatcaaaatttgctccccttggaacaagactggcttggttttgggcgttttgtattgtcgcaatctcagcagcaaagtcaaattcagtggcatgcagaaacaggtatgctctatgctgttcaacaaggtaagacatgggttttattaacaggcaaaattgttgattcagatttgatcaaacctcagcaaaatttaaccgcacttcttaagcaaaatgcacaatttattcaagaacaacaaggtcaatggttaagtacaggtgcggtgatttttgcggattattcacaacaacaagctaaatatgaaagcacgatcatgggcgggttaggtatcagcctaaccttgcttttactgttgctggttttccgtagcttacgcatattatggttatttttaccgatttctgtaggtatggttgcaggtattactgctactattagttgctttgggcagattcatattttaacgctcgtgattggcacgagtttagtgggggttctgattgatttcccattgcattggcttacatcttctctatttttaagccgatggcgtgccaataaagcgatggcaaaacttcgccttactttttttgtcagcttattggtgactttgctgggttatgctttactgggatttactgctttacctatcctaaaacagaccgcacttttttccggtatggcgttgatttttgctgtcttaacgaccttcttgtatttgcccctatttttccgacattaccagtcagataagtctttgtttttacgaagaattttgaaaataaatttccacgttaagattaattcattattaaataagattttatttgtggttagcacgggtttcattgtagtagggttgcagaaaagctattggcaagatgatattcgtcaatgggttgctatgccaacggaattgattgagcaggcacaaaaaattcgtcaaattaccggcattgatctaagcaaccaatacttattaattactgctgaaaataatgagcaattattgcaaaaagaccaaattctaaccgagaaattacaacggttcgcacaagaaaataatctgataaaatttcagtcattaagccaatggattatgtcaaaaaagcaacaagcggagtttattcaacagctaaaaaatattcctgctgaaagctatagcgtttttgatgaaattggtattccaaaggacatgattcgtcattcgctaaaaaaattggaaaaacagcctcttgtcagcttagaacaagctttaaatacagaattgggaaaagtttggaaaaatctatatttaggtgagcttgatcgaggaaaagtagcaagtattattaaagtatcaggattgaataacccaaaaattcttgagcaaattgttaataatcgggatatttactggcaggataaacctgcccatctcaatcagttgtttgagcaaacccgcaaccaagcggcttggttaaaattgctctcatttggcttggcagctttattgttgtggcgaatgtttggcatatcgcaaacgttgaaaatgctcagtatcccgcttatttcagttgtgtgtacagtcgcaattttaggttggttaaatatcaccatcagtttgtttgctatgtttgggttattattggtgtcggtcattggtattgattacattgcctatatgcaaacagcgaaagagccgttatcaataaaacgttttacgattagccttgcagcacttaccacgcttatttcatttgctttattagggttaagttccactccggcggtagcaagttttggcttgagtgtcagtttgggtgtgttgattagcttaggaatgattttgcgaataaagtgaagtaatggtgaatatattttcacatcctatcttatggctgattaattgcgatagatatatcatttttatggcaaaacaggattgcataagcactaaaactcaaaaagggctgatgtcagccccttgttgttagcatcaaattaaaataatactctcgcacgaatagtgccttcaatttgcttaagtttagccaataattgagcggtatcttctgtttcaacatcgattaccacataaccaatttttgcctcggtttgtaaatattcagctgcaatattgatattttgctccacaaatatttgattgattttatttaaaatccccggacggttatggtgaatatgtaataagcgttttgcattactatgttccggtagagatacttctgggaaatttactgccgacagtgttgaaccattatcggaatatttgacaaatttatttgcgacttcaactccaatattttcttgtgcttcaacagttgaaccgccaatgtgtggtgttaggataacattatcaaaagcacgcaatggcgagataaattcctcttcaatcgaggcaggttctttcgggaatacatcaattgcggcaccacgaatttttttgctttctaacgcctgagttaaagcgtcaatatcaaccactgtgccacgggcagcattgataaaaatacagttcgcctttaattgtgcaatgcgttccgcattcattaaattttttgttgaggaattttccggcaaatgtaatgaaaccacatcacaggtactcaaaagttcttctaagctattcatttgttgtgcattacctaaaggtaattttgtttctatatcatagaaatacacattcatgcctaacgcttctgcaataatacttagttgagatccaatatgaccataaccaataatacccaagcgttttccacgaacctcataagatcccaccatggatttattccataaacctcgatgcacatcggcattggcttgcgggatattacgcattaataataagatctcaccaagcactaattcagccacagatctggtattggcaaacggtgcattgaaaacaggaataccacgtgcttttgccgcctctaaatccacttgatttgtgccgatacaaaaacaaccaattgcaattaattttgttgcttctgctaatatatcctccgttaaagacgttcgagaacgaataccgataaaatgtgcatctttgatagcaatttttaattcatcaggttctaaggcctttcgatgatattcgatattggtatatcctgctgcttttaacacctccagtgcattttggtgtattccctccaaaagcaaaaacttaatttttgatttatctagtgatacttttgttgtcatattgcctctccatatatttaaataattattcaataatttttgtaccctccggcgtacctacaataacaatatctgcagaacgtaaagcaaaaatcccatttgttaccacgccggccacattattcaattctttttccatttctatcggattcataattttaaagttatatacatctaaaataacattaccattatctgtaaccacattttcacgatattcaggtgaaccgcccaacgccactaatttgcgtgcaacttgagagcgagccattggaatcacctctatcggcaaagcgaacgttgagcctaatacatccacttgtttagaactgtctactatacatatgaatttttttgccaatgcggctacaattttttcacgtgtcaatgctgctccgccacctttaatcatcattttttgcggattaatttcatctgcaccatcgacataaatatctaaaccggatacatcatttgcactaaatacctcgataccttgtcggagtaataattcttctgatgcttttgaagctgcgacagcacctttgattgtttcttttattgtacctaatacttcaataaaacaattgacagttgaaccgcttcctacgccaataatgctatcaggtttaacatattgcagtgcagcttgagcagccatttttttcatgcttaactgatccattttttatcctttttttatgattttatgtttatgtcgtacaaagcaaatgtttttataagttcactactttaaaactattcacttaaatacacaagctaatcaggcaaaaactccgttaataattcattaaggaaaagttttccttgttcagtgatttgccaagtgcggttcgtttctgataaatagtttttctctaacgcccaatcaatttgtttttctaccgcactttgtgctaatccagttaacagttcaaattgttgtttttccataggctccaacaaacgaaagcgattcataaaaaactcaaatggacgttctgaaaaagggatatttttttcctcatatagatattcaccacgcatatagcctttagggtgtttcgttttagaaaaacgtaaaatttgtccatcagcaaaactcaatttaccatgtgctccacacccaatggctaaataatcaccaaatctccaataattcaaattgtgttgacattgaaaatcaacttttgcataagcagaggtttcatattgttggtaacctgctttggataacaattgatgaccctgctcaaaaatatcccaaagttcatcttcatcgggtaatttcggcggacgatatgcaaacattgtattaggctcaattgtgagttgataccaagataaatgaggcggttttaaagcaatagcttgctgtaaatcgtccagtgcttgcaccaaagattgattgggtaatccgtgcattaaatccaagttaaaactgtttaatccggaatgttgagcaaaacgcaccgcactttttgcttcaactgcattatgggcacgccccagtctctgtaatttttcattattaaaactttgaatccctatagaaattcgattcactccggcttgtgcatatccgacaaaccgatcgctttcagctgttacaggatttgactcaagcgtaatttcaatattatcctcaaaaggaataagttgtttaatttgattcaataaataatcaatactttgtacagaaaataggctaggagttccgcctccaatgaaaatagaatgcaattttcggttggctattgaggcatgataacgtaccaaatcttgctttaagtcagtaagcaaatgggtaacatattcagtttccggaataagccctttttgtgcatgggagttgaaatcacaataagggcatttttgtacacaccaagggatatgtatatataaacttaatggaggtagctgaatgggaaatagtttaacaagggagaattgtgtcattatttcaaccgctcttttaatactgcgagagctttggctcgatgtgaaattttctttttctccgatgtttccagttcagcaaaagtacaacctgtttcaggatagaaaaataagctgtcataagcaaagccatttgaaccgctttcagaaaaagcaattattccatgacattcaccttcagcaataattggcgatggatcagtgtcatgttgcagcatgacaatacaactcacaaatttggcatgacgctcattaacgggcacattagccagttccgctaataacttctctctatttttctgctccgcctctttgccctcaactccggcatagcgagcggaatataatcctggtgcaccgtttagtacaggaacaaccaatccactgtcatcagcaatcgcaggtaagcctgacatttttgctgcataacgtgcttttagaagtgcattttctacaaaagtcaaacccgtttcttccggactgtcaatacctaaatctttttgtgcaacaacatcaaaaccaaattcagataatacatctgccatttcttttactttcccaggattagctgttgctagtacaattttttgtttcattaccgttcctttttcaatgaataaccagtctgctattttaagcacttcgcaggtattttttaagatgctgttttaagataagtcccctgaatgataaaatatttttgctttctacagaaatatcccctcaacattgttaaaaattgaggggatattgatttatattgtcaaaagttatttggcatgtgtctagaaaatgatgcgatctctatttttttctagtgttgctttgccaatccccttgacttcaagtaactgttcagccgcggtaaatttaccaaatttttcacgatattgaacaattgcctcggcttttttgcttccaattcctattaaagcgtgtttaatttcttccgctgttgcagtattgatgttcaatttatcgttaataatgaccggttcaacttgttgtgttgcttgggctgaactaggtggttgagttggtgtttctgcaaatgcattaaaagcacccaaagcaacacttaacatcaataatgatttgaaaaatgaggttatttttttcattttgtcttccttacagtaaatgataaccaaagtttaaaaaattgaactgttgaattgattcaacaacagacattttgcatggaggcgaaaaacttacgagaaaatcactgcacttttacgatcaggatcgcaaaaataacaaaaggggggagtaaaaagagaatttttaatgaaaaaacgagtatttgctaaaactgaatactcgtttttttgaagagaaattattgacgtactgcgatagcttcaatttcaataccgacatcttttggtaagcgagctacttcaacacaagaacgagctgggaaagttgggtgatgattttctataaagaaacgctcatactcggtatttactgtggcaaattgatttaagtctttcacaaaaacagtggttttaacaatatctgccacagtcaatcctgcttgtgcaagaattgctttaatattttccaaagattggcgagcttgtgccgtaatatctgccggaatttcccctgttgcaggattaaccggaatttgaccggaagttaaaactaaattacctaaatccacagcttgggcataggggccaattgctgccggtgctttttctgtgtgaataaattttgtcattttttctccttaatgcaacgatatttttacgctaaccattgtacgcttttaaaaataaacttaaagcccattcatggcgtttatcaagcgaatttcttcatattgtgccagatcctcgaaaaaaatttctcttgcaataattttcttttgctcaagtaattttgctcgttgtgtaccttctaataacggtttatctggagttatccattgattattttggcgaaaaatcaagtttccaatagagcaatccgttactttgccttgacgaataatcataatttcatcacattcttctttttgttttaagaggttgtttaacaatgttcgatctgaaaatttcaaactgtaatcaatatgatcacagaaaacaggtttaaaagttcgataaactttttgttggtaaggaaagcattgaagaacgtaatcatgatggttgtaatcaatacggcaacgtattaagccttctcggtgggtgaaaagtgcggtatgtttagcaataatttttgctaaatcaaatggttgtaatttcattttgggataaaacttcagcaggcttttttcataacgttgctgatgataggaaatatttttagcttgaccttgttcaattaagatcgtttcaaataaaggaaattgccacattttctgttaataattatcaaatattcatatctgcatcaaaaattatttctctacttaaatcttgagataaagaaataaaagctagctacttagttttcctcactattggataaaccgctgtttaggctctaaatagtccttaattcgcttattttatgaggggtaaatatactttagcacacagctcgttgtattcatcttctatatcactttgaattgtaatgccacctccgctacgaaaataatagccatcgctccgtttctcaataaagcgaatagcgaccgcactttgtaaggtttctccatcaaaaataccaaaaacaccggtgtagtaacctctcttttgctgctccgcttgttgaataatttccaccgttttttcttttggtgcaccgctaatagaacccgccggtaatagtgcggctaaaatatgtccaatattatgtcgccaattttcctctaactcaccacaaatttcggaacttgtttgcaaaattgcacctcgttcagtatgaattttttcaacatagcgaaaacgtttaacttcaatatttttagctacaatagctaaatcattacgcattaaatccacaatggtatagtgttcacgcaactctttttgtgaatttagtaattgttgctcagcattttctaacgttgcatttatcgtgcccttcattggataggtgtaaattttattttcataaatttgaataaacggctcaggcgaaaaacaaataaattcatttttaaacaataacttataacttgcttttgtttgttgaaataactgtattaaactataatttgtttcaattttgctcggataagtaagatttaacaaataagagttacctttttgtaactcgctcttaaccagctcaaatccctgctgataatctttaaatttcataggattaaatgaaaaatgacaatcttttgtggaaaattcaaaatgccaatctacattactttttattccttgcggttgtaaaatagtaaaaaagatattttcttttgctgcttgttcaatgggtaaaataattggtttttgctgttcaaaatcaatcaaaaagaaaaaaggtaatttattttgcccaaaataattcgcttgttgggcaaaatcacgaaattgacttgagttattcaatgacatagtgatgaaaaatttagtaatatacgcaatctgccgattttagcttaagatgaaacatgaacacaaatttattagtcattaataatcatgactcttttacttataacttagtggatctcattcgccgtttaggtacgccttttaaagttgtgaatgtagaggatttatctttggtggaaatagaaaatttttctcacctgttaatttctccgggacctgatgttcctcatgcatatccccaactttttgatttactggaaaaatactatcaatacaaatctattttgggtgtttgcttaggacatcaaactttatgtgaatttttcggcggaaaattgtataatttgcagaatgtacgtcatggacaagctaaacagctaaaagtgcggtctaattcgagactatttagaaatttacccttaacatttcaaattggactttatcattcttgggcagtaagtcctgaaaactttccggaagatcttgaaattactgcgatttgtgatgatgaagtaatcatggcgatgcaacataaaaccttgcccatttacggcgtacaatttcatcccgagtcttatatttcggagtttggtaagcaaatcatacaaaattggctaagtaattgataattataataaattcataataactattaaaaataaaaaaatgatagaaatttcctatgaattttatcaataatatccattttgttagtaaggaattattatttatcatataatcagtaaagacatcaataaacataaataggagaaagcttatgacaacaactatcggcttagatcgcaatagttcaaaacaattagcaacagaattaaataatttattagcaagttatcaaatattctacatgaatgtacgtggctatcattggaatattaaaggtgtaaatttctttgaattacacgcaaaatttgaagagatttatgatgatttagtggtgaaagtagatgaaattgcagaacgtattttaactttaggttataccccaagtaatgcgtttagtgaatatttgacacaatcgcaaattcaggagcatattaatgtaactaacgcacaggactgtttaaacggtaccctacaagggtttaaaacattgttaaaacaacaacgtagtatccttgctattgcatcagatgccaatgatgaaggtaccgcttcgcaaatgagtgattatattaaagaacatgagaaattaatttggatgttcagtgcggcttgtgaaagttgtcatgcttaatttgtgtaatatcacatcattttaaatctaaaagttaaaataaaacctctagctgtgcctagaggttttttcgtttatatgaaaagctaaatattgtgtttatttgccgatacagaaagagctaaaaatattgcctaataaatcatcggaagtaaattgtcctgtaatttcacttagatgatgttgtgctatacgcagttcttctgcgactaattcacctgcataaaattctgtcaactgaatcaatccggcttgtaaatgaatgtcggcttgttctaaggcctctaaatgacgacgacgggctaaaaatcccccctcagtgcagacttgatagcccatggactgttttaaatgctgacgcaacaaatcaacacctttttgtgtttttgccgacaatgaaataacagttaaaccgttttgttcatctaaaacttctgcttcaccacttaaatcagctttgtttcttactatggttaaaggaatatgtggcggtaattttgccataaattcagaccgcactaaatccagttcaacttgattttccgtgctatccaagattaacaaaatacgatcagcctgttcaatttcatcccaagcacgacgaataccaattttttcgacctcatcggttgcatcacgtaaccctgccgtatcaataatatgtaaaggcattccgtcaatatgaatatgttcacgcaaaacatctcgagttgttccagcaatatccgtaacaattgccgcctcacgccctgctagtgtgtttaataaactggattttccggcatttgggcgaccggcaatgactactttcattccttcacgtaaaatagccccttgttttgcctcattttttactttagctaacttggctattatttcacgtaaatgcgtttcaattttaccgtctgcaagaaagtcaatttcttcgtcagggaaatcaattgctgcttcaacataagtgcgtaaataaataactgagtcaactaattcattgattttatttgaaaactcaccttgcaatgattttaacgcagaacgtgctgcttgctccgaactcgcctcaattaaatcagcaattgcttctgcttgagctaaatctaatttatcattaagaaacgcctgttcagaaaattcgcccggtcgtgccaaacgaataccgtcaatttgcaaaatacgttttaataaaagatccatgacgatttgtccgccatgtccttgtaactcaagaacatcttctccggtaaaagaattgggagctttaaaataaagtgctatcccttgatccaatacactaccatcagaatctttaaaaggaagataatttgccatcctaggtgttaaggttttaccgagtacttgttcagcaacctgctgagctaaaggtcctgatacacgtaaaatcccaactccgccacgtccaataggcgttgcttgagctacaatagtatctctactcataatttgtttccaaaagtgcggtcaaaaatcgtatagaattataacaaaaaaggcatcatctaagatgcctttcttttatttaggattatttttttactctggtatgtaagccttttttctccaaaccacgataaattaaccattgttgtgcaatagtaataaggttagaggctaaccaatataacactaagcctgcggggaagaataagaagaacaccatgaaaattaatggcataaacgtcatcactttttgttgcatcggatcggcaacaggtgttggtgacattttttgcaataggaacattgaggcacccattaggatcggtaagataaaatacggatcctgtgcggataaatcttgtacccaaccaaagaatggggcatgacgtaattcaacggcttccataaatgtccaatacaaagcaatgaaaattggcatttgtagaagaattggtaagcaaccgccaagaggattgactttctcttctttgtaaagtttcatcatttcttggctcatacgttggcgatcttcaccaaaacgctcacgcatttcttgcaatttaggttgtaacatacgcatttttgccatcgacgtatattgtgctttggttaacgggtatagaactgcttttactactaaagtgacaccaataattgccagaccccagttttgtacaagagattggattagggttagcaatttaaatagaggtttcgcaataaaccaagcccaaccataatcaacggttaaatccaaatgattagccacatcagccatttgatcttgtaatttcggaccagtccataattgagtatgaatagtttcagttgcaccgttttctattacaatcggagcagatcgataaccaatagaacccaagtgtttcttagtatttgtcagcgtgtacaaggtattattagcatcttgattaggaatccaagcggagacgaaataatgttgcaacaaggcaacccaaccggctttggtatgaatatctaaatctgctttttccatgtcttcaaaactatattttttatagttggtttctgacgatgaataagcaccgccggtataagtcggcattgccatgctacctgaactttcaactagcgtatgagttaattgtgcataaggaactacttcaatcggtttttggctttggttggtaatttcaaaattgacctctaatgcgtaagacccgggttttaatacaaagactttacgatagatcacaccatctttctcaaagaccaaaggcacttttaattcctgctgaccttctgctaacttaaatacatcaccttcaacttggtaatttgcacgaccagcacgactatcaatgccattttttccgactaagccgctttgtgcaatatatactttatccgcattgttctgtaataagacgaaaggtgctgaagaatgtaattctgcatcatagttcaataattcagaaccgatcacgtccccccccaaagtatttacctttaaacggaaaacatcattttctaatgtaataacacgacctttagcctgtgtatcattagcaatatctgacgttgctgtaagtgcggttgagttcacttcagaaacctgagcttgttcagtcacttccggtttaggcgtgttatagtctacttgccattgctgataaataaggaaggaaatgaaaagaagtgccataaataataggctgcgtttagaatccattattcgttctctttgttgttattaatctttgggggaacaggatcgtatccgcccacattaaaaggatgacattttaatatacgtttaactgtaagccaactaccttttactacaccatgcgtttttaatgcttgaataccataacaagaacaagttggcacaaaacgacagcgaggaccaatcagcgggctaatcatcaattgataaatcctaattgcaccaattaagacttttgcaccaaacgaatgtgacgtttccatagcttatccaaagtttgaaataattgctggttatctaaattaccaatacctttctttgttattattacaaaatcataattagccagctgtccttgtaataaacggaaactttcacgagaaatgcgtttaa
